United States Patent 11,242,525 (CRISPR/CAS-RELATED METHODS AND COMPOSITIONS FOR TREATING SICKLE CELL DISEASE) - sequence listing, part 2

SEQ ID NO: 13063 - RNA, 18 nt, Artificial Sequence
  Synthetic
cgagcaggagagaagggg

SEQ ID NO: 13064 - RNA, 19 nt, Artificial Sequence
  Synthetic
gcgagcaggagagaagggg

SEQ ID NO: 13065 - RNA, 20 nt, Artificial Sequence
  Synthetic
ggcgagcaggagagaagggg

SEQ ID NO: 13066 - RNA, 21 nt, Artificial Sequence
  Synthetic
gggcgagcaggagagaagggg

SEQ ID NO: 13067 - RNA, 22 nt, Artificial Sequence
  Synthetic
agggcgagcaggagagaagggg

SEQ ID NO: 13068 - RNA, 23 nt, Artificial Sequence
  Synthetic
cagggcgagcaggagagaagggg

SEQ ID NO: 13069 - RNA, 24 nt, Artificial Sequence
  Synthetic
gcagggcgagcaggagagaagggg

SEQ ID NO: 13070 - RNA, 18 nt, Artificial Sequence
  Synthetic
agaaagggguggcagggg

SEQ ID NO: 13071 - RNA, 19 nt, Artificial Sequence
  Synthetic
aagaaagggguggcagggg

SEQ ID NO: 13072 - RNA, 20 nt, Artificial Sequence
  Synthetic
gaagaaagggguggcagggg

SEQ ID NO: 13073 - RNA, 21 nt, Artificial Sequence
  Synthetic
agaagaaagggguggcagggg

SEQ ID NO: 13074 - RNA, 22 nt, Artificial Sequence
  Synthetic
gagaagaaagggguggcagggg

SEQ ID NO: 13075 - RNA, 23 nt, Artificial Sequence
  Synthetic
agagaagaaagggguggcagggg

SEQ ID NO: 13076 - RNA, 24 nt, Artificial Sequence
  Synthetic
gagagaagaaagggguggcagggg

SEQ ID NO: 13077 - RNA, 18 nt, Artificial Sequence
  Synthetic
auggacacacaucagggg

SEQ ID NO: 13078 - RNA, 19 nt, Artificial Sequence
  Synthetic
aauggacacacaucagggg

SEQ ID NO: 13079 - RNA, 20 nt, Artificial Sequence
  Synthetic
caauggacacacaucagggg

SEQ ID NO: 13080 - RNA, 21 nt, Artificial Sequence
  Synthetic
ccaauggacacacaucagggg

SEQ ID NO: 13081 - RNA, 22 nt, Artificial Sequence
  Synthetic
accaauggacacacaucagggg

SEQ ID NO: 13082 - RNA, 23 nt, Artificial Sequence
  Synthetic
caccaauggacacacaucagggg

SEQ ID NO: 13083 - RNA, 24 nt, Artificial Sequence
  Synthetic
acaccaauggacacacaucagggg

SEQ ID NO: 13084 - RNA, 18 nt, Artificial Sequence
  Synthetic
gaggggcgggccgagggg

SEQ ID NO: 13085 - RNA, 19 nt, Artificial Sequence
  Synthetic
ggaggggcgggccgagggg

SEQ ID NO: 13086 - RNA, 20 nt, Artificial Sequence
  Synthetic
gggaggggcgggccgagggg

SEQ ID NO: 13087 - RNA, 21 nt, Artificial Sequence
  Synthetic
ggggaggggcgggccgagggg

SEQ ID NO: 13088 - RNA, 22 nt, Artificial Sequence
  Synthetic
gggggaggggcgggccgagggg

SEQ ID NO: 13089 - RNA, 23 nt, Artificial Sequence
  Synthetic
cgggggaggggcgggccgagggg

SEQ ID NO: 13090 - RNA, 24 nt, Artificial Sequence
  Synthetic
ccgggggaggggcgggccgagggg

SEQ ID NO: 13091 - RNA, 18 nt, Artificial Sequence
  Synthetic
cagacgcggcccccgggg

SEQ ID NO: 13092 - RNA, 19 nt, Artificial Sequence
  Synthetic
ccagacgcggcccccgggg

SEQ ID NO: 13093 - RNA, 20 nt, Artificial Sequence
  Synthetic
gccagacgcggcccccgggg

SEQ ID NO: 13094 - RNA, 21 nt, Artificial Sequence
  Synthetic
cgccagacgcggcccccgggg

SEQ ID NO: 13095 - RNA, 22 nt, Artificial Sequence
  Synthetic
acgccagacgcggcccccgggg

SEQ ID NO: 13096 - RNA, 23 nt, Artificial Sequence
  Synthetic
gacgccagacgcggcccccgggg

SEQ ID NO: 13097 - RNA, 24 nt, Artificial Sequence
  Synthetic
ggacgccagacgcggcccccgggg

SEQ ID NO: 13098 - RNA, 18 nt, Artificial Sequence
  Synthetic
ccaauggccagugcgggg

SEQ ID NO: 13099 - RNA, 19 nt, Artificial Sequence
  Synthetic
gccaauggccagugcgggg

SEQ ID NO: 13100 - RNA, 20 nt, Artificial Sequence
  Synthetic
agccaauggccagugcgggg

SEQ ID NO: 13101 - RNA, 21 nt, Artificial Sequence
  Synthetic
aagccaauggccagugcgggg

SEQ ID NO: 13102 - RNA, 22 nt, Artificial Sequence
  Synthetic
caagccaauggccagugcgggg

SEQ ID NO: 13103 - RNA, 23 nt, Artificial Sequence
  Synthetic
acaagccaauggccagugcgggg

SEQ ID NO: 13104 - RNA, 24 nt, Artificial Sequence
  Synthetic
gacaagccaauggccagugcgggg

SEQ ID NO: 13105 - RNA, 18 nt, Artificial Sequence
  Synthetic
ggagggggaggugcgggg

SEQ ID NO: 13106 - RNA, 19 nt, Artificial Sequence
  Synthetic
gggagggggaggugcgggg

SEQ ID NO: 13107 - RNA, 20 nt, Artificial Sequence
  Synthetic
ggggagggggaggugcgggg

SEQ ID NO: 13108 - RNA, 21 nt, Artificial Sequence
  Synthetic
cggggagggggaggugcgggg

SEQ ID NO: 13109 - RNA, 22 nt, Artificial Sequence
  Synthetic
gcggggagggggaggugcgggg

SEQ ID NO: 13110 - RNA, 23 nt, Artificial Sequence
  Synthetic
ugcggggagggggaggugcgggg

SEQ ID NO: 13111 - RNA, 24 nt, Artificial Sequence
  Synthetic
gugcggggagggggaggugcgggg

SEQ ID NO: 13112 - RNA, 18 nt, Artificial Sequence
  Synthetic
agacgcggcccccggggg

SEQ ID NO: 13113 - RNA, 19 nt, Artificial Sequence
  Synthetic
cagacgcggcccccggggg

SEQ ID NO: 13114 - RNA, 20 nt, Artificial Sequence
  Synthetic
ccagacgcggcccccggggg

SEQ ID NO: 13115 - RNA, 21 nt, Artificial Sequence
  Synthetic
gccagacgcggcccccggggg

SEQ ID NO: 13116 - RNA, 22 nt, Artificial Sequence
  Synthetic
cgccagacgcggcccccggggg

SEQ ID NO: 13117 - RNA, 23 nt, Artificial Sequence
  Synthetic
acgccagacgcggcccccggggg

SEQ ID NO: 13118 - RNA, 24 nt, Artificial Sequence
  Synthetic
gacgccagacgcggcccccggggg

SEQ ID NO: 13119 - RNA, 18 nt, Artificial Sequence
  Synthetic
ugggaggaaagggugggg

SEQ ID NO: 13120 - RNA, 19 nt, Artificial Sequence
  Synthetic
gugggaggaaagggugggg

SEQ ID NO: 13121 - RNA, 20 nt, Artificial Sequence
  Synthetic
ggugggaggaaagggugggg

SEQ ID NO: 13122 - RNA, 21 nt, Artificial Sequence
  Synthetic
gggugggaggaaagggugggg

SEQ ID NO: 13123 - RNA, 22 nt, Artificial Sequence
  Synthetic
ggggugggaggaaagggugggg

SEQ ID NO: 13124 - RNA, 23 nt, Artificial Sequence
  Synthetic
aggggugggaggaaagggugggg

SEQ ID NO: 13125 - RNA, 24 nt, Artificial Sequence
  Synthetic
caggggugggaggaaagggugggg

SEQ ID NO: 13126 - RNA, 18 nt, Artificial Sequence
  Synthetic
agacacacaaaacauggg

SEQ ID NO: 13127 - RNA, 19 nt, Artificial Sequence
  Synthetic
gagacacacaaaacauggg

SEQ ID NO: 13128 - RNA, 20 nt, Artificial Sequence
  Synthetic
agagacacacaaaacauggg

SEQ ID NO: 13129 - RNA, 21 nt, Artificial Sequence
  Synthetic
cagagacacacaaaacauggg

SEQ ID NO: 13130 - RNA, 22 nt, Artificial Sequence
  Synthetic
acagagacacacaaaacauggg

SEQ ID NO: 13131 - RNA, 23 nt, Artificial Sequence
  Synthetic
gacagagacacacaaaacauggg

SEQ ID NO: 13132 - RNA, 24 nt, Artificial Sequence
  Synthetic
ggacagagacacacaaaacauggg

SEQ ID NO: 13133 - RNA, 18 nt, Artificial Sequence
  Synthetic
gcaaugguuccagauggg

SEQ ID NO: 13134 - RNA, 19 nt, Artificial Sequence
  Synthetic
ggcaaugguuccagauggg

SEQ ID NO: 13135 - RNA, 20 nt, Artificial Sequence
  Synthetic
cggcaaugguuccagauggg

SEQ ID NO: 13136 - RNA, 21 nt, Artificial Sequence
  Synthetic
acggcaaugguuccagauggg

SEQ ID NO: 13137 - RNA, 22 nt, Artificial Sequence
  Synthetic
cacggcaaugguuccagauggg

SEQ ID NO: 13138 - RNA, 23 nt, Artificial Sequence
  Synthetic
acacggcaaugguuccagauggg

SEQ ID NO: 13139 - RNA, 24 nt, Artificial Sequence
  Synthetic
uacacggcaaugguuccagauggg

SEQ ID NO: 13140 - RNA, 18 nt, Artificial Sequence
  Synthetic
gugggaggaaaggguggg

SEQ ID NO: 13141 - RNA, 19 nt, Artificial Sequence
  Synthetic
ggugggaggaaaggguggg

SEQ ID NO: 13142 - RNA, 20 nt, Artificial Sequence
  Synthetic
gggugggaggaaaggguggg

SEQ ID NO: 13143 - RNA, 21 nt, Artificial Sequence
  Synthetic
ggggugggaggaaaggguggg

SEQ ID NO: 13144 - RNA, 22 nt, Artificial Sequence
  Synthetic
aggggugggaggaaaggguggg

SEQ ID NO: 13145 - RNA, 23 nt, Artificial Sequence
  Synthetic
caggggugggaggaaaggguggg

SEQ ID NO: 13146 - RNA, 24 nt, Artificial Sequence
  Synthetic
gcaggggugggaggaaaggguggg

SEQ ID NO: 13147 - RNA, 18 nt, Artificial Sequence
  Synthetic
agggguggcagggguggg

SEQ ID NO: 13148 - RNA, 19 nt, Artificial Sequence
  Synthetic
aagggguggcagggguggg

SEQ ID NO: 13149 - RNA, 20 nt, Artificial Sequence
  Synthetic
aaagggguggcagggguggg

SEQ ID NO: 13150 - RNA, 21 nt, Artificial Sequence
  Synthetic
gaaagggguggcagggguggg

SEQ ID NO: 13151 - RNA, 22 nt, Artificial Sequence
  Synthetic
agaaagggguggcagggguggg

SEQ ID NO: 13152 - RNA, 23 nt, Artificial Sequence
  Synthetic
aagaaagggguggcagggguggg

SEQ ID NO: 13153 - RNA, 24 nt, Artificial Sequence
  Synthetic
gaagaaagggguggcagggguggg

SEQ ID NO: 13154 - RNA, 18 nt, Artificial Sequence
  Synthetic
ugaacgucaggagucugg

SEQ ID NO: 13155 - RNA, 19 nt, Artificial Sequence
  Synthetic
uugaacgucaggagucugg

SEQ ID NO: 13156 - RNA, 20 nt, Artificial Sequence
  Synthetic
cuugaacgucaggagucugg

SEQ ID NO: 13157 - RNA, 21 nt, Artificial Sequence
  Synthetic
acuugaacgucaggagucugg

SEQ ID NO: 13158 - RNA, 22 nt, Artificial Sequence
  Synthetic
aacuugaacgucaggagucugg

SEQ ID NO: 13159 - RNA, 23 nt, Artificial Sequence
  Synthetic
gaacuugaacgucaggagucugg

SEQ ID NO: 13160 - RNA, 24 nt, Artificial Sequence
  Synthetic
cgaacuugaacgucaggagucugg

SEQ ID NO: 13161 - RNA, 18 nt, Artificial Sequence
  Synthetic
gccgcggcgguggcgugg

SEQ ID NO: 13162 - RNA, 19 nt, Artificial Sequence
  Synthetic
cgccgcggcgguggcgugg

SEQ ID NO: 13163 - RNA, 20 nt, Artificial Sequence
  Synthetic
gcgccgcggcgguggcgugg

SEQ ID NO: 13164 - RNA, 21 nt, Artificial Sequence
  Synthetic
agcgccgcggcgguggcgugg

SEQ ID NO: 13165 - RNA, 22 nt, Artificial Sequence
  Synthetic
gagcgccgcggcgguggcgugg

SEQ ID NO: 13166 - RNA, 23 nt, Artificial Sequence
  Synthetic
cgagcgccgcggcgguggcgugg

SEQ ID NO: 13167 - RNA, 24 nt, Artificial Sequence
  Synthetic
gcgagcgccgcggcgguggcgugg

SEQ ID NO: 13168 - RNA, 18 nt, Artificial Sequence
  Synthetic
ggugggaggaaagggugg

SEQ ID NO: 13169 - RNA, 19 nt, Artificial Sequence
  Synthetic
gggugggaggaaagggugg

SEQ ID NO: 13170 - RNA, 20 nt, Artificial Sequence
  Synthetic
ggggugggaggaaagggugg

SEQ ID NO: 13171 - RNA, 21 nt, Artificial Sequence
  Synthetic
aggggugggaggaaagggugg

SEQ ID NO: 13172 - RNA, 22 nt, Artificial Sequence
  Synthetic
caggggugggaggaaagggugg

SEQ ID NO: 13173 - RNA, 23 nt, Artificial Sequence
  Synthetic
gcaggggugggaggaaagggugg

SEQ ID NO: 13174 - RNA, 24 nt, Artificial Sequence
  Synthetic
ggcaggggugggaggaaagggugg

SEQ ID NO: 13175 - RNA, 18 nt, Artificial Sequence
  Synthetic
gagagaagaaaggggugg

SEQ ID NO: 13176 - RNA, 19 nt, Artificial Sequence
  Synthetic
ggagagaagaaaggggugg

SEQ ID NO: 13177 - RNA, 20 nt, Artificial Sequence
  Synthetic
gggagagaagaaaggggugg

SEQ ID NO: 13178 - RNA, 21 nt, Artificial Sequence
  Synthetic
cgggagagaagaaaggggugg

SEQ ID NO: 13179 - RNA, 22 nt, Artificial Sequence
  Synthetic
ccgggagagaagaaaggggugg

SEQ ID NO: 13180 - RNA, 23 nt, Artificial Sequence
  Synthetic
gccgggagagaagaaaggggugg

SEQ ID NO: 13181 - RNA, 24 nt, Artificial Sequence
  Synthetic
ggccgggagagaagaaaggggugg

SEQ ID NO: 13182 - RNA, 18 nt, Artificial Sequence
  Synthetic
aagggguggcaggggugg

SEQ ID NO: 13183 - RNA, 19 nt, Artificial Sequence
  Synthetic
aaagggguggcaggggugg

SEQ ID NO: 13184 - RNA, 20 nt, Artificial Sequence
  Synthetic
gaaagggguggcaggggugg

SEQ ID NO: 13185 - RNA, 21 nt, Artificial Sequence
  Synthetic
agaaagggguggcaggggugg

SEQ ID NO: 13186 - RNA, 22 nt, Artificial Sequence
  Synthetic
aagaaagggguggcaggggugg

SEQ ID NO: 13187 - RNA, 23 nt, Artificial Sequence
  Synthetic
gaagaaagggguggcaggggugg

SEQ ID NO: 13188 - RNA, 24 nt, Artificial Sequence
  Synthetic
agaagaaagggguggcaggggugg

SEQ ID NO: 13189 - RNA, 18 nt, Artificial Sequence
  Synthetic
agggaagaugaauugugg

SEQ ID NO: 13190 - RNA, 19 nt, Artificial Sequence
  Synthetic
cagggaagaugaauugugg

SEQ ID NO: 13191 - RNA, 20 nt, Artificial Sequence
  Synthetic
gcagggaagaugaauugugg

SEQ ID NO: 13192 - RNA, 21 nt, Artificial Sequence
  Synthetic
cgcagggaagaugaauugugg

SEQ ID NO: 13193 - RNA, 22 nt, Artificial Sequence
  Synthetic
gcgcagggaagaugaauugugg

SEQ ID NO: 13194 - RNA, 23 nt, Artificial Sequence
  Synthetic
ggcgcagggaagaugaauugugg

SEQ ID NO: 13195 - RNA, 24 nt, Artificial Sequence
  Synthetic
uggcgcagggaagaugaauugugg

SEQ ID NO: 13196 - RNA, 18 nt, Artificial Sequence
  Synthetic
ugcuugcggcgagacaug

SEQ ID NO: 13197 - RNA, 19 nt, Artificial Sequence
  Synthetic
uugcuugcggcgagacaug

SEQ ID NO: 13198 - RNA, 20 nt, Artificial Sequence
  Synthetic
cuugcuugcggcgagacaug

SEQ ID NO: 13199 - RNA, 21 nt, Artificial Sequence
  Synthetic
ccuugcuugcggcgagacaug

SEQ ID NO: 13200 - RNA, 22 nt, Artificial Sequence
  Synthetic
gccuugcuugcggcgagacaug

SEQ ID NO: 13201 - RNA, 23 nt, Artificial Sequence
  Synthetic
ugccuugcuugcggcgagacaug

SEQ ID NO: 13202 - RNA, 24 nt, Artificial Sequence
  Synthetic
uugccuugcuugcggcgagacaug

SEQ ID NO: 13203 - RNA, 18 nt, Artificial Sequence
  Synthetic
gcgagacauggugggcug

SEQ ID NO: 13204 - RNA, 19 nt, Artificial Sequence
  Synthetic
ggcgagacauggugggcug

SEQ ID NO: 13205 - RNA, 20 nt, Artificial Sequence
  Synthetic
cggcgagacauggugggcug

SEQ ID NO: 13206 - RNA, 21 nt, Artificial Sequence
  Synthetic
gcggcgagacauggugggcug

SEQ ID NO: 13207 - RNA, 22 nt, Artificial Sequence
  Synthetic
ugcggcgagacauggugggcug

SEQ ID NO: 13208 - RNA, 23 nt, Artificial Sequence
  Synthetic
uugcggcgagacauggugggcug

SEQ ID NO: 13209 - RNA, 24 nt, Artificial Sequence
  Synthetic
cuugcggcgagacauggugggcug

SEQ ID NO: 13210 - RNA, 18 nt, Artificial Sequence
  Synthetic
uucccguuugcuuaagug

SEQ ID NO: 13211 - RNA, 19 nt, Artificial Sequence
  Synthetic
auucccguuugcuuaagug

SEQ ID NO: 13212 - RNA, 20 nt, Artificial Sequence
  Synthetic
aauucccguuugcuuaagug

SEQ ID NO: 13213 - RNA, 21 nt, Artificial Sequence
  Synthetic
gaauucccguuugcuuaagug

SEQ ID NO: 13214 - RNA, 22 nt, Artificial Sequence
  Synthetic
agaauucccguuugcuuaagug

SEQ ID NO: 13215 - RNA, 23 nt, Artificial Sequence
  Synthetic
gagaauucccguuugcuuaagug

SEQ ID NO: 13216 - RNA, 24 nt, Artificial Sequence
  Synthetic
cgagaauucccguuugcuuaagug

SEQ ID NO: 13217 - RNA, 18 nt, Artificial Sequence
  Synthetic
acaagccaauggccagug

SEQ ID NO: 13218 - RNA, 19 nt, Artificial Sequence
  Synthetic
gacaagccaauggccagug

SEQ ID NO: 13219 - RNA, 20 nt, Artificial Sequence
  Synthetic
ggacaagccaauggccagug

SEQ ID NO: 13220 - RNA, 21 nt, Artificial Sequence
  Synthetic
aggacaagccaauggccagug

SEQ ID NO: 13221 - RNA, 22 nt, Artificial Sequence
  Synthetic
caggacaagccaauggccagug

SEQ ID NO: 13222 - RNA, 23 nt, Artificial Sequence
  Synthetic
ccaggacaagccaauggccagug

SEQ ID NO: 13223 - RNA, 24 nt, Artificial Sequence
  Synthetic
accaggacaagccaauggccagug

SEQ ID NO: 13224 - RNA, 18 nt, Artificial Sequence
  Synthetic
ugcggggagggggaggug

SEQ ID NO: 13225 - RNA, 19 nt, Artificial Sequence
  Synthetic
gugcggggagggggaggug

SEQ ID NO: 13226 - RNA, 20 nt, Artificial Sequence
  Synthetic
agugcggggagggggaggug

SEQ ID NO: 13227 - RNA, 21 nt, Artificial Sequence
  Synthetic
cagugcggggagggggaggug

SEQ ID NO: 13228 - RNA, 22 nt, Artificial Sequence
  Synthetic
ccagugcggggagggggaggug

SEQ ID NO: 13229 - RNA, 23 nt, Artificial Sequence
  Synthetic
gccagugcggggagggggaggug

SEQ ID NO: 13230 - RNA, 24 nt, Artificial Sequence
  Synthetic
ggccagugcggggagggggaggug

SEQ ID NO: 13231 - RNA, 18 nt, Artificial Sequence
  Synthetic
gggugggaggaaagggug

SEQ ID NO: 13232 - RNA, 19 nt, Artificial Sequence
  Synthetic
ggggugggaggaaagggug

SEQ ID NO: 13233 - RNA, 20 nt, Artificial Sequence
  Synthetic
aggggugggaggaaagggug

SEQ ID NO: 13234 - RNA, 21 nt, Artificial Sequence
  Synthetic
caggggugggaggaaagggug

SEQ ID NO: 13235 - RNA, 22 nt, Artificial Sequence
  Synthetic
gcaggggugggaggaaagggug

SEQ ID NO: 13236 - RNA, 23 nt, Artificial Sequence
  Synthetic
ggcaggggugggaggaaagggug

SEQ ID NO: 13237 - RNA, 24 nt, Artificial Sequence
  Synthetic
uggcaggggugggaggaaagggug

SEQ ID NO: 13238 - RNA, 18 nt, Artificial Sequence
  Synthetic
cgcagggaagaugaauug

SEQ ID NO: 13239 - RNA, 19 nt, Artificial Sequence
  Synthetic
gcgcagggaagaugaauug

SEQ ID NO: 13240 - RNA, 20 nt, Artificial Sequence
  Synthetic
ggcgcagggaagaugaauug

SEQ ID NO: 13241 - RNA, 21 nt, Artificial Sequence
  Synthetic
uggcgcagggaagaugaauug

SEQ ID NO: 13242 - RNA, 22 nt, Artificial Sequence
  Synthetic
auggcgcagggaagaugaauug

SEQ ID NO: 13243 - RNA, 23 nt, Artificial Sequence
  Synthetic
gauggcgcagggaagaugaauug

SEQ ID NO: 13244 - RNA, 24 nt, Artificial Sequence
  Synthetic
agauggcgcagggaagaugaauug

SEQ ID NO: 13245 - RNA, 18 nt, Artificial Sequence
  Synthetic
uugacauccaaaauaaau

SEQ ID NO: 13246 - RNA, 19 nt, Artificial Sequence
  Synthetic
uuugacauccaaaauaaau

SEQ ID NO: 13247 - RNA, 20 nt, Artificial Sequence
  Synthetic
uuuugacauccaaaauaaau

SEQ ID NO: 13248 - RNA, 21 nt, Artificial Sequence
  Synthetic
cuuuugacauccaaaauaaau

SEQ ID NO: 13249 - RNA, 22 nt, Artificial Sequence
  Synthetic
ccuuuugacauccaaaauaaau

SEQ ID NO: 13250 - RNA, 23 nt, Artificial Sequence
  Synthetic
gccuuuugacauccaaaauaaau

SEQ ID NO: 13251 - RNA, 24 nt, Artificial Sequence
  Synthetic
ugccuuuugacauccaaaauaaau

SEQ ID NO: 13252 - RNA, 18 nt, Artificial Sequence
  Synthetic
acaccaauggacacacau

SEQ ID NO: 13253 - RNA, 19 nt, Artificial Sequence
  Synthetic
cacaccaauggacacacau

SEQ ID NO: 13254 - RNA, 20 nt, Artificial Sequence
  Synthetic
ucacaccaauggacacacau

SEQ ID NO: 13255 - RNA, 21 nt, Artificial Sequence
  Synthetic
cucacaccaauggacacacau

SEQ ID NO: 13256 - RNA, 22 nt, Artificial Sequence
  Synthetic
gcucacaccaauggacacacau

SEQ ID NO: 13257 - RNA, 23 nt, Artificial Sequence
  Synthetic
agcucacaccaauggacacacau

SEQ ID NO: 13258 - RNA, 24 nt, Artificial Sequence
  Synthetic
aagcucacaccaauggacacacau

SEQ ID NO: 13259 - RNA, 18 nt, Artificial Sequence
  Synthetic
cgacggcucgguucacau

SEQ ID NO: 13260 - RNA, 19 nt, Artificial Sequence
  Synthetic
acgacggcucgguucacau

SEQ ID NO: 13261 - RNA, 20 nt, Artificial Sequence
  Synthetic
gacgacggcucgguucacau

SEQ ID NO: 13262 - RNA, 21 nt, Artificial Sequence
  Synthetic
ggacgacggcucgguucacau

SEQ ID NO: 13263 - RNA, 22 nt, Artificial Sequence
  Synthetic
cggacgacggcucgguucacau

SEQ ID NO: 13264 - RNA, 23 nt, Artificial Sequence
  Synthetic
gcggacgacggcucgguucacau

SEQ ID NO: 13265 - RNA, 24 nt, Artificial Sequence
  Synthetic
ggcggacgacggcucgguucacau

SEQ ID NO: 13266 - RNA, 18 nt, Artificial Sequence
  Synthetic
ugcggacgugacgucccu

SEQ ID NO: 13267 - RNA, 19 nt, Artificial Sequence
  Synthetic
gugcggacgugacgucccu

SEQ ID NO: 13268 - RNA, 20 nt, Artificial Sequence
  Synthetic
agugcggacgugacgucccu

SEQ ID NO: 13269 - RNA, 21 nt, Artificial Sequence
  Synthetic
aagugcggacgugacgucccu

SEQ ID NO: 13270 - RNA, 22 nt, Artificial Sequence
  Synthetic
caagugcggacgugacgucccu

SEQ ID NO: 13271 - RNA, 23 nt, Artificial Sequence
  Synthetic
ucaagugcggacgugacgucccu

SEQ ID NO: 13272 - RNA, 24 nt, Artificial Sequence
  Synthetic
uucaagugcggacgugacgucccu

SEQ ID NO: 13273 - RNA, 18 nt, Artificial Sequence
  Synthetic
ggcgagacauggugggcu

SEQ ID NO: 13274 - RNA, 19 nt, Artificial Sequence
  Synthetic
cggcgagacauggugggcu

SEQ ID NO: 13275 - RNA, 20 nt, Artificial Sequence
  Synthetic
gcggcgagacauggugggcu

SEQ ID NO: 13276 - RNA, 21 nt, Artificial Sequence
  Synthetic
ugcggcgagacauggugggcu

SEQ ID NO: 13277 - RNA, 22 nt, Artificial Sequence
  Synthetic
uugcggcgagacauggugggcu

SEQ ID NO: 13278 - RNA, 23 nt, Artificial Sequence
  Synthetic
cuugcggcgagacauggugggcu

SEQ ID NO: 13279 - RNA, 24 nt, Artificial Sequence
  Synthetic
gcuugcggcgagacauggugggcu

SEQ ID NO: 13280 - RNA, 18 nt, Artificial Sequence
  Synthetic
cucuuuuaccucgacucu

SEQ ID NO: 13281 - RNA, 19 nt, Artificial Sequence
  Synthetic
ucucuuuuaccucgacucu

SEQ ID NO: 13282 - RNA, 20 nt, Artificial Sequence
  Synthetic
aucucuuuuaccucgacucu

SEQ ID NO: 13283 - RNA, 21 nt, Artificial Sequence
  Synthetic
uaucucuuuuaccucgacucu

SEQ ID NO: 13284 - RNA, 22 nt, Artificial Sequence
  Synthetic
uuaucucuuuuaccucgacucu

SEQ ID NO: 13285 - RNA, 23 nt, Artificial Sequence
  Synthetic
uuuaucucuuuuaccucgacucu

SEQ ID NO: 13286 - RNA, 24 nt, Artificial Sequence
  Synthetic
cuuuaucucuuuuaccucgacucu

SEQ ID NO: 13287 - RNA, 18 nt, Artificial Sequence
  Synthetic
ugagcugcaaguucaagu

SEQ ID NO: 13288 - RNA, 19 nt, Artificial Sequence
  Synthetic
cugagcugcaaguucaagu

SEQ ID NO: 13289 - RNA, 20 nt, Artificial Sequence
  Synthetic
ccugagcugcaaguucaagu

SEQ ID NO: 13290 - RNA, 21 nt, Artificial Sequence
  Synthetic
cccugagcugcaaguucaagu

SEQ ID NO: 13291 - RNA, 22 nt, Artificial Sequence
  Synthetic
ccccugagcugcaaguucaagu

SEQ ID NO: 13292 - RNA, 23 nt, Artificial Sequence
  Synthetic
cccccugagcugcaaguucaagu

SEQ ID NO: 13293 - RNA, 24 nt, Artificial Sequence
  Synthetic
ccccccugagcugcaaguucaagu

SEQ ID NO: 13294 - RNA, 18 nt, Artificial Sequence
  Synthetic
gacaagccaauggccagu

SEQ ID NO: 13295 - RNA, 19 nt, Artificial Sequence
  Synthetic
ggacaagccaauggccagu

SEQ ID NO: 13296 - RNA, 20 nt, Artificial Sequence
  Synthetic
aggacaagccaauggccagu

SEQ ID NO: 13297 - RNA, 21 nt, Artificial Sequence
  Synthetic
caggacaagccaauggccagu

SEQ ID NO: 13298 - RNA, 22 nt, Artificial Sequence
  Synthetic
ccaggacaagccaauggccagu

SEQ ID NO: 13299 - RNA, 23 nt, Artificial Sequence
  Synthetic
accaggacaagccaauggccagu

SEQ ID NO: 13300 - RNA, 24 nt, Artificial Sequence
  Synthetic
gaccaggacaagccaauggccagu

SEQ ID NO: 13301 - RNA, 18 nt, Artificial Sequence
  Synthetic
cccugcgaacuugaacgu

SEQ ID NO: 13302 - RNA, 19 nt, Artificial Sequence
  Synthetic
ucccugcgaacuugaacgu

SEQ ID NO: 13303 - RNA, 20 nt, Artificial Sequence
  Synthetic
gucccugcgaacuugaacgu

SEQ ID NO: 13304 - RNA, 21 nt, Artificial Sequence
  Synthetic
cgucccugcgaacuugaacgu

SEQ ID NO: 13305 - RNA, 22 nt, Artificial Sequence
  Synthetic
acgucccugcgaacuugaacgu

SEQ ID NO: 13306 - RNA, 23 nt, Artificial Sequence
  Synthetic
gacgucccugcgaacuugaacgu

SEQ ID NO: 13307 - RNA, 24 nt, Artificial Sequence
  Synthetic
ugacgucccugcgaacuugaacgu

SEQ ID NO: 13308 - RNA, 18 nt, Artificial Sequence
  Synthetic
gugcggggagggggaggu

SEQ ID NO: 13309 - RNA, 19 nt, Artificial Sequence
  Synthetic
agugcggggagggggaggu

SEQ ID NO: 13310 - RNA, 20 nt, Artificial Sequence
  Synthetic
cagugcggggagggggaggu

SEQ ID NO: 13311 - RNA, 21 nt, Artificial Sequence
  Synthetic
ccagugcggggagggggaggu

SEQ ID NO: 13312 - RNA, 22 nt, Artificial Sequence
  Synthetic
gccagugcggggagggggaggu

SEQ ID NO: 13313 - RNA, 23 nt, Artificial Sequence
  Synthetic
ggccagugcggggagggggaggu

SEQ ID NO: 13314 - RNA, 24 nt, Artificial Sequence
  Synthetic
uggccagugcggggagggggaggu

SEQ ID NO: 13315 - RNA, 18 nt, Artificial Sequence
  Synthetic
ggggugggaggaaagggu

SEQ ID NO: 13316 - RNA, 19 nt, Artificial Sequence
  Synthetic
aggggugggaggaaagggu

SEQ ID NO: 13317 - RNA, 20 nt, Artificial Sequence
  Synthetic
caggggugggaggaaagggu

SEQ ID NO: 13318 - RNA, 21 nt, Artificial Sequence
  Synthetic
gcaggggugggaggaaagggu

SEQ ID NO: 13319 - RNA, 22 nt, Artificial Sequence
  Synthetic
ggcaggggugggaggaaagggu

SEQ ID NO: 13320 - RNA, 23 nt, Artificial Sequence
  Synthetic
uggcaggggugggaggaaagggu

SEQ ID NO: 13321 - RNA, 24 nt, Artificial Sequence
  Synthetic
guggcaggggugggaggaaagggu

SEQ ID NO: 13322 - RNA, 18 nt, Artificial Sequence
  Synthetic
acaucgggagagccgggu

SEQ ID NO: 13323 - RNA, 19 nt, Artificial Sequence
  Synthetic
cacaucgggagagccgggu

SEQ ID NO: 13324 - RNA, 20 nt, Artificial Sequence
  Synthetic
ucacaucgggagagccgggu

SEQ ID NO: 13325 - RNA, 21 nt, Artificial Sequence
  Synthetic
uucacaucgggagagccgggu

SEQ ID NO: 13326 - RNA, 22 nt, Artificial Sequence
  Synthetic
guucacaucgggagagccgggu

SEQ ID NO: 13327 - RNA, 23 nt, Artificial Sequence
  Synthetic
gguucacaucgggagagccgggu

SEQ ID NO: 13328 - RNA, 24 nt, Artificial Sequence
  Synthetic
cgguucacaucgggagagccgggu

SEQ ID NO: 13329 - RNA, 18 nt, Artificial Sequence
  Synthetic
gaaagggguggcaggggu

SEQ ID NO: 13330 - RNA, 19 nt, Artificial Sequence
  Synthetic
agaaagggguggcaggggu

SEQ ID NO: 13331 - RNA, 20 nt, Artificial Sequence
  Synthetic
aagaaagggguggcaggggu

SEQ ID NO: 13332 - RNA, 21 nt, Artificial Sequence
  Synthetic
gaagaaagggguggcaggggu

SEQ ID NO: 13333 - RNA, 22 nt, Artificial Sequence
  Synthetic
agaagaaagggguggcaggggu

SEQ ID NO: 13334 - RNA, 23 nt, Artificial Sequence
  Synthetic
gagaagaaagggguggcaggggu

SEQ ID NO: 13335 - RNA, 24 nt, Artificial Sequence
  Synthetic
agagaagaaagggguggcaggggu

SEQ ID NO: 13336 - RNA, 18 nt, Artificial Sequence
  Synthetic
gcagggaagaugaauugu

SEQ ID NO: 13337 - RNA, 19 nt, Artificial Sequence
  Synthetic
cgcagggaagaugaauugu

SEQ ID NO: 13338 - RNA, 20 nt, Artificial Sequence
  Synthetic
gcgcagggaagaugaauugu

SEQ ID NO: 13339 - RNA, 21 nt, Artificial Sequence
  Synthetic
ggcgcagggaagaugaauugu

SEQ ID NO: 13340 - RNA, 22 nt, Artificial Sequence
  Synthetic
uggcgcagggaagaugaauugu

SEQ ID NO: 13341 - RNA, 23 nt, Artificial Sequence
  Synthetic
auggcgcagggaagaugaauugu

SEQ ID NO: 13342 - RNA, 24 nt, Artificial Sequence
  Synthetic
gauggcgcagggaagaugaauugu

SEQ ID NO: 13343 - RNA, 18 nt, Artificial Sequence
  Synthetic
gcgcagggaagaugaauu

SEQ ID NO: 13344 - RNA, 19 nt, Artificial Sequence
  Synthetic
ggcgcagggaagaugaauu

SEQ ID NO: 13345 - RNA, 20 nt, Artificial Sequence
  Synthetic
uggcgcagggaagaugaauu

SEQ ID NO: 13346 - RNA, 21 nt, Artificial Sequence
  Synthetic
auggcgcagggaagaugaauu

SEQ ID NO: 13347 - RNA, 22 nt, Artificial Sequence
  Synthetic
gauggcgcagggaagaugaauu

SEQ ID NO: 13348 - RNA, 23 nt, Artificial Sequence
  Synthetic
agauggcgcagggaagaugaauu

SEQ ID NO: 13349 - RNA, 24 nt, Artificial Sequence
  Synthetic
aagauggcgcagggaagaugaauu

SEQ ID NO: 13350 - RNA, 18 nt, Artificial Sequence
  Synthetic
gcaggacuagaagcaaaa

SEQ ID NO: 13351 - RNA, 19 nt, Artificial Sequence
  Synthetic
cgcaggacuagaagcaaaa

SEQ ID NO: 13352 - RNA, 20 nt, Artificial Sequence
  Synthetic
gcgcaggacuagaagcaaaa

SEQ ID NO: 13353 - RNA, 21 nt, Artificial Sequence
  Synthetic
cgcgcaggacuagaagcaaaa

SEQ ID NO: 13354 - RNA, 22 nt, Artificial Sequence
  Synthetic
gcgcgcaggacuagaagcaaaa

SEQ ID NO: 13355 - RNA, 23 nt, Artificial Sequence
  Synthetic
agcgcgcaggacuagaagcaaaa

SEQ ID NO: 13356 - RNA, 24 nt, Artificial Sequence
  Synthetic
gagcgcgcaggacuagaagcaaaa

SEQ ID NO: 13357 - RNA, 18 nt, Artificial Sequence
  Synthetic
ccccagcacuuaagcaaa

SEQ ID NO: 13358 - RNA, 19 nt, Artificial Sequence
  Synthetic
accccagcacuuaagcaaa

SEQ ID NO: 13359 - RNA, 20 nt, Artificial Sequence
  Synthetic
aaccccagcacuuaagcaaa

SEQ ID NO: 13360 - RNA, 21 nt, Artificial Sequence
  Synthetic
aaaccccagcacuuaagcaaa

SEQ ID NO: 13361 - RNA, 22 nt, Artificial Sequence
  Synthetic
caaaccccagcacuuaagcaaa

SEQ ID NO: 13362 - RNA, 23 nt, Artificial Sequence
  Synthetic
gcaaaccccagcacuuaagcaaa

SEQ ID NO: 13363 - RNA, 24 nt, Artificial Sequence
  Synthetic
ggcaaaccccagcacuuaagcaaa

SEQ ID NO: 13364 - RNA, 18 nt, Artificial Sequence
  Synthetic
cgagguaaaagagauaaa

SEQ ID NO: 13365 - RNA, 19 nt, Artificial Sequence
  Synthetic
ucgagguaaaagagauaaa

SEQ ID NO: 13366 - RNA, 20 nt, Artificial Sequence
  Synthetic
gucgagguaaaagagauaaa

SEQ ID NO: 13367 - RNA, 21 nt, Artificial Sequence
  Synthetic
agucgagguaaaagagauaaa

SEQ ID NO: 13368 - RNA, 22 nt, Artificial Sequence
  Synthetic
gagucgagguaaaagagauaaa

SEQ ID NO: 13369 - RNA, 23 nt, Artificial Sequence
  Synthetic
agagucgagguaaaagagauaaa

SEQ ID NO: 13370 - RNA, 24 nt, Artificial Sequence
  Synthetic
gagagucgagguaaaagagauaaa

SEQ ID NO: 13371 - RNA, 18 nt, Artificial Sequence
  Synthetic
accccagcacuuaagcaa

SEQ ID NO: 13372 - RNA, 19 nt, Artificial Sequence
  Synthetic
aaccccagcacuuaagcaa

SEQ ID NO: 13373 - RNA, 20 nt, Artificial Sequence
  Synthetic
aaaccccagcacuuaagcaa

SEQ ID NO: 13374 - RNA, 21 nt, Artificial Sequence
  Synthetic
caaaccccagcacuuaagcaa

SEQ ID NO: 13375 - RNA, 22 nt, Artificial Sequence
  Synthetic
gcaaaccccagcacuuaagcaa

SEQ ID NO: 13376 - RNA, 23 nt, Artificial Sequence
  Synthetic
ggcaaaccccagcacuuaagcaa

SEQ ID NO: 13377 - RNA, 24 nt, Artificial Sequence
  Synthetic
aggcaaaccccagcacuuaagcaa

SEQ ID NO: 13378 - RNA, 18 nt, Artificial Sequence
  Synthetic
cggcucucccgaugugaa

SEQ ID NO: 13379 - RNA, 19 nt, Artificial Sequence
  Synthetic
ccggcucucccgaugugaa

SEQ ID NO: 13380 - RNA, 20 nt, Artificial Sequence
  Synthetic
cccggcucucccgaugugaa

SEQ ID NO: 13381 - RNA, 21 nt, Artificial Sequence
  Synthetic
acccggcucucccgaugugaa

SEQ ID NO: 13382 - RNA, 22 nt, Artificial Sequence
  Synthetic
aacccggcucucccgaugugaa

SEQ ID NO: 13383 - RNA, 23 nt, Artificial Sequence
  Synthetic
uaacccggcucucccgaugugaa

SEQ ID NO: 13384 - RNA, 24 nt, Artificial Sequence
  Synthetic
cuaacccggcucucccgaugugaa

SEQ ID NO: 13385 - RNA, 18 nt, Artificial Sequence
  Synthetic
ucgagguaaaagagauaa

SEQ ID NO: 13386 - RNA, 19 nt, Artificial Sequence
  Synthetic
gucgagguaaaagagauaa

SEQ ID NO: 13387 - RNA, 20 nt, Artificial Sequence
  Synthetic
agucgagguaaaagagauaa

SEQ ID NO: 13388 - RNA, 21 nt, Artificial Sequence
  Synthetic
gagucgagguaaaagagauaa

SEQ ID NO: 13389 - RNA, 22 nt, Artificial Sequence
  Synthetic
agagucgagguaaaagagauaa

SEQ ID NO: 13390 - RNA, 23 nt, Artificial Sequence
  Synthetic
gagagucgagguaaaagagauaa

SEQ ID NO: 13391 - RNA, 24 nt, Artificial Sequence
  Synthetic
cgagagucgagguaaaagagauaa

SEQ ID NO: 13392 - RNA, 18 nt, Artificial Sequence
  Synthetic
cuccgagagucgagguaa

SEQ ID NO: 13393 - RNA, 19 nt, Artificial Sequence
  Synthetic
ccuccgagagucgagguaa

SEQ ID NO: 13394 - RNA, 20 nt, Artificial Sequence
  Synthetic
accuccgagagucgagguaa

SEQ ID NO: 13395 - RNA, 21 nt, Artificial Sequence
  Synthetic
aaccuccgagagucgagguaa

SEQ ID NO: 13396 - RNA, 22 nt, Artificial Sequence
  Synthetic
aaaccuccgagagucgagguaa

SEQ ID NO: 13397 - RNA, 23 nt, Artificial Sequence
  Synthetic
aaaaccuccgagagucgagguaa

SEQ ID NO: 13398 - RNA, 24 nt, Artificial Sequence
  Synthetic
aaaaaccuccgagagucgagguaa

SEQ ID NO: 13399 - RNA, 18 nt, Artificial Sequence
  Synthetic
acuugaacuugcagcuca

SEQ ID NO: 13400 - RNA, 19 nt, Artificial Sequence
  Synthetic
cacuugaacuugcagcuca

SEQ ID NO: 13401 - RNA, 20 nt, Artificial Sequence
  Synthetic
gcacuugaacuugcagcuca

SEQ ID NO: 13402 - RNA, 21 nt, Artificial Sequence
  Synthetic
cgcacuugaacuugcagcuca

SEQ ID NO: 13403 - RNA, 22 nt, Artificial Sequence
  Synthetic
ccgcacuugaacuugcagcuca

SEQ ID NO: 13404 - RNA, 23 nt, Artificial Sequence
  Synthetic
uccgcacuugaacuugcagcuca

SEQ ID NO: 13405 - RNA, 24 nt, Artificial Sequence
  Synthetic
guccgcacuugaacuugcagcuca

SEQ ID NO: 13406 - RNA, 18 nt, Artificial Sequence
  Synthetic
gcaaaagcgagggggaga

SEQ ID NO: 13407 - RNA, 19 nt, Artificial Sequence
  Synthetic
agcaaaagcgagggggaga

SEQ ID NO: 13408 - RNA, 20 nt, Artificial Sequence
  Synthetic
aagcaaaagcgagggggaga

SEQ ID NO: 13409 - RNA, 21 nt, Artificial Sequence
  Synthetic
gaagcaaaagcgagggggaga

SEQ ID NO: 13410 - RNA, 22 nt, Artificial Sequence
  Synthetic
agaagcaaaagcgagggggaga

SEQ ID NO: 13411 - RNA, 23 nt, Artificial Sequence
  Synthetic
uagaagcaaaagcgagggggaga

SEQ ID NO: 13412 - RNA, 24 nt, Artificial Sequence
  Synthetic
cuagaagcaaaagcgagggggaga

SEQ ID NO: 13413 - RNA, 18 nt, Artificial Sequence
  Synthetic
gacuagaagcaaaagcga

SEQ ID NO: 13414 - RNA, 19 nt, Artificial Sequence
  Synthetic
ggacuagaagcaaaagcga

SEQ ID NO: 13415 - RNA, 20 nt, Artificial Sequence
  Synthetic
aggacuagaagcaaaagcga

SEQ ID NO: 13416 - RNA, 21 nt, Artificial Sequence
  Synthetic
caggacuagaagcaaaagcga

SEQ ID NO: 13417 - RNA, 22 nt, Artificial Sequence
  Synthetic
gcaggacuagaagcaaaagcga

SEQ ID NO: 13418 - RNA, 23 nt, Artificial Sequence
  Synthetic
cgcaggacuagaagcaaaagcga

SEQ ID NO: 13419 - RNA, 24 nt, Artificial Sequence
  Synthetic
gcgcaggacuagaagcaaaagcga

SEQ ID NO: 13420 - RNA, 18 nt, Artificial Sequence
  Synthetic
aagcaaaagcgaggggga

SEQ ID NO: 13421 - RNA, 19 nt, Artificial Sequence
  Synthetic
gaagcaaaagcgaggggga

SEQ ID NO: 13422 - RNA, 20 nt, Artificial Sequence
  Synthetic
agaagcaaaagcgaggggga

SEQ ID NO: 13423 - RNA, 21 nt, Artificial Sequence
  Synthetic
uagaagcaaaagcgaggggga

SEQ ID NO: 13424 - RNA, 22 nt, Artificial Sequence
  Synthetic
cuagaagcaaaagcgaggggga

SEQ ID NO: 13425 - RNA, 23 nt, Artificial Sequence
  Synthetic
acuagaagcaaaagcgaggggga

SEQ ID NO: 13426 - RNA, 24 nt, Artificial Sequence
  Synthetic
gacuagaagcaaaagcgaggggga

SEQ ID NO: 13427 - RNA, 18 nt, Artificial Sequence
  Synthetic
gucgagguaaaagagaua

SEQ ID NO: 13428 - RNA, 19 nt, Artificial Sequence
  Synthetic
agucgagguaaaagagaua

SEQ ID NO: 13429 - RNA, 20 nt, Artificial Sequence
  Synthetic
gagucgagguaaaagagaua

SEQ ID NO: 13430 - RNA, 21 nt, Artificial Sequence
  Synthetic
agagucgagguaaaagagaua

SEQ ID NO: 13431 - RNA, 22 nt, Artificial Sequence
  Synthetic
gagagucgagguaaaagagaua

SEQ ID NO: 13432 - RNA, 23 nt, Artificial Sequence
  Synthetic
cgagagucgagguaaaagagaua

SEQ ID NO: 13433 - RNA, 24 nt, Artificial Sequence
  Synthetic
ccgagagucgagguaaaagagaua

SEQ ID NO: 13434 - RNA, 18 nt, Artificial Sequence
  Synthetic
gggacgucacguccgcac

SEQ ID NO: 13435 - RNA, 19 nt, Artificial Sequence
  Synthetic
agggacgucacguccgcac

SEQ ID NO: 13436 - RNA, 20 nt, Artificial Sequence
  Synthetic
cagggacgucacguccgcac

SEQ ID NO: 13437 - RNA, 21 nt, Artificial Sequence
  Synthetic
gcagggacgucacguccgcac

SEQ ID NO: 13438 - RNA, 22 nt, Artificial Sequence
  Synthetic
cgcagggacgucacguccgcac

SEQ ID NO: 13439 - RNA, 23 nt, Artificial Sequence
  Synthetic
ucgcagggacgucacguccgcac

SEQ ID NO: 13440 - RNA, 24 nt, Artificial Sequence
  Synthetic
uucgcagggacgucacguccgcac

SEQ ID NO: 13441 - RNA, 18 nt, Artificial Sequence
  Synthetic
auaauuauuaauaaucac

SEQ ID NO: 13442 - RNA, 19 nt, Artificial Sequence
  Synthetic
aauaauuauuaauaaucac

SEQ ID NO: 13443 - RNA, 20 nt, Artificial Sequence
  Synthetic
uaauaauuauuaauaaucac

SEQ ID NO: 13444 - RNA, 21 nt, Artificial Sequence
  Synthetic
auaauaauuauuaauaaucac

SEQ ID NO: 13445 - RNA, 22 nt, Artificial Sequence
  Synthetic
aauaauaauuauuaauaaucac

SEQ ID NO: 13446 - RNA, 23 nt, Artificial Sequence
  Synthetic
uaauaauaauuauuaauaaucac

SEQ ID NO: 13447 - RNA, 24 nt, Artificial Sequence
  Synthetic
guaauaauaauuauuaauaaucac

SEQ ID NO: 13448 - RNA, 18 nt, Artificial Sequence
  Synthetic
cauuuuuaaauuuuucac

SEQ ID NO: 13449 - RNA, 19 nt, Artificial Sequence
  Synthetic
gcauuuuuaaauuuuucac

SEQ ID NO: 13450 - RNA, 20 nt, Artificial Sequence
  Synthetic
ugcauuuuuaaauuuuucac

SEQ ID NO: 13451 - RNA, 21 nt, Artificial Sequence
  Synthetic
augcauuuuuaaauuuuucac

SEQ ID NO: 13452 - RNA, 22 nt, Artificial Sequence
  Synthetic
caugcauuuuuaaauuuuucac

SEQ ID NO: 13453 - RNA, 23 nt, Artificial Sequence
  Synthetic
gcaugcauuuuuaaauuuuucac

SEQ ID NO: 13454 - RNA, 24 nt, Artificial Sequence
  Synthetic
ugcaugcauuuuuaaauuuuucac

SEQ ID NO: 13455 - RNA, 18 nt, Artificial Sequence
  Synthetic
cacgagagcgcgcaggac

SEQ ID NO: 13456 - RNA, 19 nt, Artificial Sequence
  Synthetic
ucacgagagcgcgcaggac

SEQ ID NO: 13457 - RNA, 20 nt, Artificial Sequence
  Synthetic
aucacgagagcgcgcaggac

SEQ ID NO: 13458 - RNA, 21 nt, Artificial Sequence
  Synthetic
aaucacgagagcgcgcaggac

SEQ ID NO: 13459 - RNA, 22 nt, Artificial Sequence
  Synthetic
uaaucacgagagcgcgcaggac

SEQ ID NO: 13460 - RNA, 23 nt, Artificial Sequence
  Synthetic
auaaucacgagagcgcgcaggac

SEQ ID NO: 13461 - RNA, 24 nt, Artificial Sequence
  Synthetic
aauaaucacgagagcgcgcaggac

SEQ ID NO: 13462 - RNA, 18 nt, Artificial Sequence
  Synthetic
ucggcccgccccuccccc

SEQ ID NO: 13463 - RNA, 19 nt, Artificial Sequence
  Synthetic
cucggcccgccccuccccc

SEQ ID NO: 13464 - RNA, 20 nt, Artificial Sequence
  Synthetic
ccucggcccgccccuccccc

SEQ ID NO: 13465 - RNA, 21 nt, Artificial Sequence
  Synthetic
cccucggcccgccccuccccc

SEQ ID NO: 13466 - RNA, 22 nt, Artificial Sequence
  Synthetic
ccccucggcccgccccuccccc

SEQ ID NO: 13467 - RNA, 23 nt, Artificial Sequence
  Synthetic
uccccucggcccgccccuccccc

SEQ ID NO: 13468 - RNA, 24 nt, Artificial Sequence
  Synthetic
cuccccucggcccgccccuccccc

SEQ ID NO: 13469 - RNA, 18 nt, Artificial Sequence
  Synthetic
cucggcccgccccucccc

SEQ ID NO: 13470 - RNA, 19 nt, Artificial Sequence
  Synthetic
ccucggcccgccccucccc

SEQ ID NO: 13471 - RNA, 20 nt, Artificial Sequence
  Synthetic
cccucggcccgccccucccc

SEQ ID NO: 13472 - RNA, 21 nt, Artificial Sequence
  Synthetic
ccccucggcccgccccucccc

SEQ ID NO: 13473 - RNA, 22 nt, Artificial Sequence
  Synthetic
uccccucggcccgccccucccc

SEQ ID NO: 13474 - RNA, 23 nt, Artificial Sequence
  Synthetic
cuccccucggcccgccccucccc

SEQ ID NO: 13475 - RNA, 24 nt, Artificial Sequence
  Synthetic
ccuccccucggcccgccccucccc

SEQ ID NO: 13476 - RNA, 18 nt, Artificial Sequence
  Synthetic
ccucggcccgccccuccc

SEQ ID NO: 13477 - RNA, 19 nt, Artificial Sequence
  Synthetic
cccucggcccgccccuccc

SEQ ID NO: 13478 - RNA, 20 nt, Artificial Sequence
  Synthetic
ccccucggcccgccccuccc

SEQ ID NO: 13479 - RNA, 21 nt, Artificial Sequence
  Synthetic
uccccucggcccgccccuccc

SEQ ID NO: 13480 - RNA, 22 nt, Artificial Sequence
  Synthetic
cuccccucggcccgccccuccc

SEQ ID NO: 13481 - RNA, 23 nt, Artificial Sequence
  Synthetic
ccuccccucggcccgccccuccc

SEQ ID NO: 13482 - RNA, 24 nt, Artificial Sequence
  Synthetic
cccuccccucggcccgccccuccc

SEQ ID NO: 13483 - RNA, 18 nt, Artificial Sequence
  Synthetic
gggccgcgucuggcgucc

SEQ ID NO: 13484 - RNA, 19 nt, Artificial Sequence
  Synthetic
ggggccgcgucuggcgucc

SEQ ID NO: 13485 - RNA, 20 nt, Artificial Sequence
  Synthetic
gggggccgcgucuggcgucc

SEQ ID NO: 13486 - RNA, 21 nt, Artificial Sequence
  Synthetic
cgggggccgcgucuggcgucc

SEQ ID NO: 13487 - RNA, 22 nt, Artificial Sequence
  Synthetic
ccgggggccgcgucuggcgucc

SEQ ID NO: 13488 - RNA, 23 nt, Artificial Sequence
  Synthetic
cccgggggccgcgucuggcgucc

SEQ ID NO: 13489 - RNA, 24 nt, Artificial Sequence
  Synthetic
ccccgggggccgcgucuggcgucc

SEQ ID NO: 13490 - RNA, 18 nt, Artificial Sequence
  Synthetic
aggacuagaagcaaaagc

SEQ ID NO: 13491 - RNA, 19 nt, Artificial Sequence
  Synthetic
caggacuagaagcaaaagc

SEQ ID NO: 13492 - RNA, 20 nt, Artificial Sequence
  Synthetic
gcaggacuagaagcaaaagc

SEQ ID NO: 13493 - RNA, 21 nt, Artificial Sequence
  Synthetic
cgcaggacuagaagcaaaagc

SEQ ID NO: 13494 - RNA, 22 nt, Artificial Sequence
  Synthetic
gcgcaggacuagaagcaaaagc

SEQ ID NO: 13495 - RNA, 23 nt, Artificial Sequence
  Synthetic
cgcgcaggacuagaagcaaaagc

SEQ ID NO: 13496 - RNA, 24 nt, Artificial Sequence
  Synthetic
gcgcgcaggacuagaagcaaaagc

SEQ ID NO: 13497 - RNA, 18 nt, Artificial Sequence
  Synthetic
ccugacguucaaguucgc

SEQ ID NO: 13498 - RNA, 19 nt, Artificial Sequence
  Synthetic
uccugacguucaaguucgc

SEQ ID NO: 13499 - RNA, 20 nt, Artificial Sequence
  Synthetic
cuccugacguucaaguucgc

SEQ ID NO: 13500 - RNA, 21 nt, Artificial Sequence
  Synthetic
acuccugacguucaaguucgc

SEQ ID NO: 13501 - RNA, 22 nt, Artificial Sequence
  Synthetic
gacuccugacguucaaguucgc

SEQ ID NO: 13502 - RNA, 23 nt, Artificial Sequence
  Synthetic
agacuccugacguucaaguucgc

SEQ ID NO: 13503 - RNA, 24 nt, Artificial Sequence
  Synthetic
cagacuccugacguucaaguucgc

SEQ ID NO: 13504 - RNA, 18 nt, Artificial Sequence
  Synthetic
uaauaauuauuaauaauc

SEQ ID NO: 13505 - RNA, 19 nt, Artificial Sequence
  Synthetic
auaauaauuauuaauaauc

SEQ ID NO: 13506 - RNA, 20 nt, Artificial Sequence
  Synthetic
aauaauaauuauuaauaauc

SEQ ID NO: 13507 - RNA, 21 nt, Artificial Sequence
  Synthetic
uaauaauaauuauuaauaauc

SEQ ID NO: 13508 - RNA, 22 nt, Artificial Sequence
  Synthetic
guaauaauaauuauuaauaauc

SEQ ID NO: 13509 - RNA, 23 nt, Artificial Sequence
  Synthetic
aguaauaauaauuauuaauaauc

SEQ ID NO: 13510 - RNA, 24 nt, Artificial Sequence
  Synthetic
uaguaauaauaauuauuaauaauc

SEQ ID NO: 13511 - RNA, 18 nt, Artificial Sequence
  Synthetic
aaaaacccucaucccauc

SEQ ID NO: 13512 - RNA, 19 nt, Artificial Sequence
  Synthetic
aaaaaacccucaucccauc

SEQ ID NO: 13513 - RNA, 20 nt, Artificial Sequence
  Synthetic
gaaaaaacccucaucccauc

SEQ ID NO: 13514 - RNA, 21 nt, Artificial Sequence
  Synthetic
ggaaaaaacccucaucccauc

SEQ ID NO: 13515 - RNA, 22 nt, Artificial Sequence
  Synthetic
gggaaaaaacccucaucccauc

SEQ ID NO: 13516 - RNA, 23 nt, Artificial Sequence
  Synthetic
ggggaaaaaacccucaucccauc

SEQ ID NO: 13517 - RNA, 24 nt, Artificial Sequence
  Synthetic
gggggaaaaaacccucaucccauc

SEQ ID NO: 13518 - RNA, 18 nt, Artificial Sequence
  Synthetic
cacuugaacuugcagcuc

SEQ ID NO: 13519 - RNA, 19 nt, Artificial Sequence
  Synthetic
gcacuugaacuugcagcuc

SEQ ID NO: 13520 - RNA, 20 nt, Artificial Sequence
  Synthetic
cgcacuugaacuugcagcuc

SEQ ID NO: 13521 - RNA, 21 nt, Artificial Sequence
  Synthetic
ccgcacuugaacuugcagcuc

SEQ ID NO: 13522 - RNA, 22 nt, Artificial Sequence
  Synthetic
uccgcacuugaacuugcagcuc

SEQ ID NO: 13523 - RNA, 23 nt, Artificial Sequence
  Synthetic
guccgcacuugaacuugcagcuc

SEQ ID NO: 13524 - RNA, 24 nt, Artificial Sequence
  Synthetic
cguccgcacuugaacuugcagcuc

SEQ ID NO: 13525 - RNA, 18 nt, Artificial Sequence
  Synthetic
ugcauuuuuaaauuuuuc

SEQ ID NO: 13526 - RNA, 19 nt, Artificial Sequence
  Synthetic
augcauuuuuaaauuuuuc

SEQ ID NO: 13527 - RNA, 20 nt, Artificial Sequence
  Synthetic
caugcauuuuuaaauuuuuc

SEQ ID NO: 13528 - RNA, 21 nt, Artificial Sequence
  Synthetic
gcaugcauuuuuaaauuuuuc

SEQ ID NO: 13529 - RNA, 22 nt, Artificial Sequence
  Synthetic
ugcaugcauuuuuaaauuuuuc

SEQ ID NO: 13530 - RNA, 23 nt, Artificial Sequence
  Synthetic
gugcaugcauuuuuaaauuuuuc

SEQ ID NO: 13531 - RNA, 24 nt, Artificial Sequence
  Synthetic
ugugcaugcauuuuuaaauuuuuc

SEQ ID NO: 13532 - RNA, 18 nt, Artificial Sequence
  Synthetic
gagguaaaagagauaaag

SEQ ID NO: 13533 - RNA, 19 nt, Artificial Sequence
  Synthetic
cgagguaaaagagauaaag

SEQ ID NO: 13534 - RNA, 20 nt, Artificial Sequence
  Synthetic
ucgagguaaaagagauaaag

SEQ ID NO: 13535 - RNA, 21 nt, Artificial Sequence
  Synthetic
gucgagguaaaagagauaaag

SEQ ID NO: 13536 - RNA, 22 nt, Artificial Sequence
  Synthetic
agucgagguaaaagagauaaag

SEQ ID NO: 13537 - RNA, 23 nt, Artificial Sequence
  Synthetic
gagucgagguaaaagagauaaag

SEQ ID NO: 13538 - RNA, 24 nt, Artificial Sequence
  Synthetic
agagucgagguaaaagagauaaag

SEQ ID NO: 13539 - RNA, 18 nt, Artificial Sequence
  Synthetic
cuugaacuugcagcucag

SEQ ID NO: 13540 - RNA, 19 nt, Artificial Sequence
  Synthetic
acuugaacuugcagcucag

SEQ ID NO: 13541 - RNA, 20 nt, Artificial Sequence
  Synthetic
cacuugaacuugcagcucag

SEQ ID NO: 13542 - RNA, 21 nt, Artificial Sequence
  Synthetic
gcacuugaacuugcagcucag

SEQ ID NO: 13543 - RNA, 22 nt, Artificial Sequence
  Synthetic
cgcacuugaacuugcagcucag

SEQ ID NO: 13544 - RNA, 23 nt, Artificial Sequence
  Synthetic
ccgcacuugaacuugcagcucag

SEQ ID NO: 13545 - RNA, 24 nt, Artificial Sequence
  Synthetic
uccgcacuugaacuugcagcucag

SEQ ID NO: 13546 - RNA, 18 nt, Artificial Sequence
  Synthetic
gagaaaaaccuccgagag

SEQ ID NO: 13547 - RNA, 19 nt, Artificial Sequence
  Synthetic
cgagaaaaaccuccgagag

SEQ ID NO: 13548 - RNA, 20 nt, Artificial Sequence
  Synthetic
acgagaaaaaccuccgagag

SEQ ID NO: 13549 - RNA, 21 nt, Artificial Sequence
  Synthetic
cacgagaaaaaccuccgagag

SEQ ID NO: 13550 - RNA, 22 nt, Artificial Sequence
  Synthetic
ucacgagaaaaaccuccgagag

SEQ ID NO: 13551 - RNA, 23 nt, Artificial Sequence
  Synthetic
uucacgagaaaaaccuccgagag

SEQ ID NO: 13552 - RNA, 24 nt, Artificial Sequence
  Synthetic
uuucacgagaaaaaccuccgagag

SEQ ID NO: 13553 - RNA, 18 nt, Artificial Sequence
  Synthetic
acuagaagcaaaagcgag

SEQ ID NO: 13554 - RNA, 19 nt, Artificial Sequence
  Synthetic
gacuagaagcaaaagcgag

SEQ ID NO: 13555 - RNA, 20 nt, Artificial Sequence
  Synthetic
ggacuagaagcaaaagcgag

SEQ ID NO: 13556 - RNA, 21 nt, Artificial Sequence
  Synthetic
aggacuagaagcaaaagcgag

SEQ ID NO: 13557 - RNA, 22 nt, Artificial Sequence
  Synthetic
caggacuagaagcaaaagcgag

SEQ ID NO: 13558 - RNA, 23 nt, Artificial Sequence
  Synthetic
gcaggacuagaagcaaaagcgag

SEQ ID NO: 13559 - RNA, 24 nt, Artificial Sequence
  Synthetic
cgcaggacuagaagcaaaagcgag

SEQ ID NO: 13560 - RNA, 18 nt, Artificial Sequence
  Synthetic
cgcgugugugggggggag

SEQ ID NO: 13561 - RNA, 19 nt, Artificial Sequence
  Synthetic
ccgcgugugugggggggag

SEQ ID NO: 13562 - RNA, 20 nt, Artificial Sequence
  Synthetic
uccgcgugugugggggggag

SEQ ID NO: 13563 - RNA, 21 nt, Artificial Sequence
  Synthetic
guccgcgugugugggggggag

SEQ ID NO: 13564 - RNA, 22 nt, Artificial Sequence
  Synthetic
aguccgcgugugugggggggag

SEQ ID NO: 13565 - RNA, 23 nt, Artificial Sequence
  Synthetic
gaguccgcgugugugggggggag

SEQ ID NO: 13566 - RNA, 24 nt, Artificial Sequence
  Synthetic
agaguccgcgugugugggggggag

SEQ ID NO: 13567 - RNA, 18 nt, Artificial Sequence
  Synthetic
ggccgcgucuggcguccg

SEQ ID NO: 13568 - RNA, 19 nt, Artificial Sequence
  Synthetic
gggccgcgucuggcguccg

SEQ ID NO: 13569 - RNA, 20 nt, Artificial Sequence
  Synthetic
ggggccgcgucuggcguccg

SEQ ID NO: 13570 - RNA, 21 nt, Artificial Sequence
  Synthetic
gggggccgcgucuggcguccg

SEQ ID NO: 13571 - RNA, 22 nt, Artificial Sequence
  Synthetic
cgggggccgcgucuggcguccg

SEQ ID NO: 13572 - RNA, 23 nt, Artificial Sequence
  Synthetic
ccgggggccgcgucuggcguccg

SEQ ID NO: 13573 - RNA, 24 nt, Artificial Sequence
  Synthetic
cccgggggccgcgucuggcguccg

SEQ ID NO: 13574 - RNA, 18 nt, Artificial Sequence
  Synthetic
ggacuagaagcaaaagcg

SEQ ID NO: 13575 - RNA, 19 nt, Artificial Sequence
  Synthetic
aggacuagaagcaaaagcg

SEQ ID NO: 13576 - RNA, 20 nt, Artificial Sequence
  Synthetic
caggacuagaagcaaaagcg

SEQ ID NO: 13577 - RNA, 21 nt, Artificial Sequence
  Synthetic
gcaggacuagaagcaaaagcg

SEQ ID NO: 13578 - RNA, 22 nt, Artificial Sequence
  Synthetic
cgcaggacuagaagcaaaagcg

SEQ ID NO: 13579 - RNA, 23 nt, Artificial Sequence
  Synthetic
gcgcaggacuagaagcaaaagcg

SEQ ID NO: 13580 - RNA, 24 nt, Artificial Sequence
  Synthetic
cgcgcaggacuagaagcaaaagcg

SEQ ID NO: 13581 - RNA, 18 nt, Artificial Sequence
  Synthetic
aauaaucacgagagcgcg

SEQ ID NO: 13582 - RNA, 19 nt, Artificial Sequence
  Synthetic
uaauaaucacgagagcgcg

SEQ ID NO: 13583 - RNA, 20 nt, Artificial Sequence
  Synthetic
uuaauaaucacgagagcgcg

SEQ ID NO: 13584 - RNA, 21 nt, Artificial Sequence
  Synthetic
auuaauaaucacgagagcgcg

SEQ ID NO: 13585 - RNA, 22 nt, Artificial Sequence
  Synthetic
uauuaauaaucacgagagcgcg

SEQ ID NO: 13586 - RNA, 23 nt, Artificial Sequence
  Synthetic
uuauuaauaaucacgagagcgcg

SEQ ID NO: 13587 - RNA, 24 nt, Artificial Sequence
  Synthetic
auuauuaauaaucacgagagcgcg

SEQ ID NO: 13588 - RNA, 18 nt, Artificial Sequence
  Synthetic
uccugacguucaaguucg

SEQ ID NO: 13589 - RNA, 19 nt, Artificial Sequence
  Synthetic
cuccugacguucaaguucg

SEQ ID NO: 13590 - RNA, 20 nt, Artificial Sequence
  Synthetic
acuccugacguucaaguucg

SEQ ID NO: 13591 - RNA, 21 nt, Artificial Sequence
  Synthetic
gacuccugacguucaaguucg

SEQ ID NO: 13592 - RNA, 22 nt, Artificial Sequence
  Synthetic
agacuccugacguucaaguucg

SEQ ID NO: 13593 - RNA, 23 nt, Artificial Sequence
  Synthetic
cagacuccugacguucaaguucg

SEQ ID NO: 13594 - RNA, 24 nt, Artificial Sequence
  Synthetic
ccagacuccugacguucaaguucg

SEQ ID NO: 13595 - RNA, 18 nt, Artificial Sequence
  Synthetic
agguaaaagagauaaagg

SEQ ID NO: 13596 - RNA, 19 nt, Artificial Sequence
  Synthetic
gagguaaaagagauaaagg

SEQ ID NO: 13597 - RNA, 20 nt, Artificial Sequence
  Synthetic
cgagguaaaagagauaaagg

SEQ ID NO: 13598 - RNA, 21 nt, Artificial Sequence
  Synthetic
ucgagguaaaagagauaaagg

SEQ ID NO: 13599 - RNA, 22 nt, Artificial Sequence
  Synthetic
gucgagguaaaagagauaaagg

SEQ ID NO: 13600 - RNA, 23 nt, Artificial Sequence
  Synthetic
agucgagguaaaagagauaaagg

SEQ ID NO: 13601 - RNA, 24 nt, Artificial Sequence
  Synthetic
gagucgagguaaaagagauaaagg

SEQ ID NO: 13602 - RNA, 18 nt, Artificial Sequence
  Synthetic
cuagaagcaaaagcgagg

SEQ ID NO: 13603 - RNA, 19 nt, Artificial Sequence
  Synthetic
acuagaagcaaaagcgagg

SEQ ID NO: 13604 - RNA, 20 nt, Artificial Sequence
  Synthetic
gacuagaagcaaaagcgagg

SEQ ID NO: 13605 - RNA, 21 nt, Artificial Sequence
  Synthetic
ggacuagaagcaaaagcgagg

SEQ ID NO: 13606 - RNA, 22 nt, Artificial Sequence
  Synthetic
aggacuagaagcaaaagcgagg

SEQ ID NO: 13607 - RNA, 23 nt, Artificial Sequence
  Synthetic
caggacuagaagcaaaagcgagg

SEQ ID NO: 13608 - RNA, 24 nt, Artificial Sequence
  Synthetic
gcaggacuagaagcaaaagcgagg

SEQ ID NO: 13609 - RNA, 18 nt, Artificial Sequence
  Synthetic
agaagcaaaagcgagggg

SEQ ID NO: 13610 - RNA, 19 nt, Artificial Sequence
  Synthetic
uagaagcaaaagcgagggg

SEQ ID NO: 13611 - RNA, 20 nt, Artificial Sequence
  Synthetic
cuagaagcaaaagcgagggg

SEQ ID NO: 13612 - RNA, 21 nt, Artificial Sequence
  Synthetic
acuagaagcaaaagcgagggg

SEQ ID NO: 13613 - RNA, 22 nt, Artificial Sequence
  Synthetic
gacuagaagcaaaagcgagggg

SEQ ID NO: 13614 - RNA, 23 nt, Artificial Sequence
  Synthetic
ggacuagaagcaaaagcgagggg

SEQ ID NO: 13615 - RNA, 24 nt, Artificial Sequence
  Synthetic
aggacuagaagcaaaagcgagggg

SEQ ID NO: 13616 - RNA, 18 nt, Artificial Sequence
  Synthetic
gaguccgcgugugugggg

SEQ ID NO: 13617 - RNA, 19 nt, Artificial Sequence
  Synthetic
agaguccgcgugugugggg

SEQ ID NO: 13618 - RNA, 20 nt, Artificial Sequence
  Synthetic
uagaguccgcgugugugggg

SEQ ID NO: 13619 - RNA, 21 nt, Artificial Sequence
  Synthetic
uuagaguccgcgugugugggg

SEQ ID NO: 13620 - RNA, 22 nt, Artificial Sequence
  Synthetic
uuuagaguccgcgugugugggg

SEQ ID NO: 13621 - RNA, 23 nt, Artificial Sequence
  Synthetic
uuuuagaguccgcgugugugggg

SEQ ID NO: 13622 - RNA, 24 nt, Artificial Sequence
  Synthetic
auuuuagaguccgcgugugugggg

SEQ ID NO: 13623 - RNA, 18 nt, Artificial Sequence
  Synthetic
agaguccgcguguguggg

SEQ ID NO: 13624 - RNA, 19 nt, Artificial Sequence
  Synthetic
uagaguccgcguguguggg

SEQ ID NO: 13625 - RNA, 20 nt, Artificial Sequence
  Synthetic
uuagaguccgcguguguggg

SEQ ID NO: 13626 - RNA, 21 nt, Artificial Sequence
  Synthetic
uuuagaguccgcguguguggg

SEQ ID NO: 13627 - RNA, 22 nt, Artificial Sequence
  Synthetic
uuuuagaguccgcguguguggg

SEQ ID NO: 13628 - RNA, 23 nt, Artificial Sequence
  Synthetic
auuuuagaguccgcguguguggg

SEQ ID NO: 13629 - RNA, 24 nt, Artificial Sequence
  Synthetic
cauuuuagaguccgcguguguggg

SEQ ID NO: 13630 - RNA, 18 nt, Artificial Sequence
  Synthetic
uagaguccgcgugugugg

SEQ ID NO: 13631 - RNA, 19 nt, Artificial Sequence
  Synthetic
uuagaguccgcgugugugg

SEQ ID NO: 13632 - RNA, 20 nt, Artificial Sequence
  Synthetic
uuuagaguccgcgugugugg

SEQ ID NO: 13633 - RNA, 21 nt, Artificial Sequence
  Synthetic
uuuuagaguccgcgugugugg

SEQ ID NO: 13634 - RNA, 22 nt, Artificial Sequence
  Synthetic
auuuuagaguccgcgugugugg

SEQ ID NO: 13635 - RNA, 23 nt, Artificial Sequence
  Synthetic
cauuuuagaguccgcgugugugg

SEQ ID NO: 13636 - RNA, 24 nt, Artificial Sequence
  Synthetic
ucauuuuagaguccgcgugugugg

SEQ ID NO: 13637 - RNA, 18 nt, Artificial Sequence
  Synthetic
cgcucgcugcggccacug

SEQ ID NO: 13638 - RNA, 19 nt, Artificial Sequence
  Synthetic
gcgcucgcugcggccacug

SEQ ID NO: 13639 - RNA, 20 nt, Artificial Sequence
  Synthetic
ggcgcucgcugcggccacug

SEQ ID NO: 13640 - RNA, 21 nt, Artificial Sequence
  Synthetic
cggcgcucgcugcggccacug

SEQ ID NO: 13641 - RNA, 22 nt, Artificial Sequence
  Synthetic
gcggcgcucgcugcggccacug

SEQ ID NO: 13642 - RNA, 23 nt, Artificial Sequence
  Synthetic
cgcggcgcucgcugcggccacug

SEQ ID NO: 13643 - RNA, 24 nt, Artificial Sequence
  Synthetic
ccgcggcgcucgcugcggccacug

SEQ ID NO: 13644 - RNA, 18 nt, Artificial Sequence
  Synthetic
ggaugucaaaaggcacug

SEQ ID NO: 13645 - RNA, 19 nt, Artificial Sequence
  Synthetic
uggaugucaaaaggcacug

SEQ ID NO: 13646 - RNA, 20 nt, Artificial Sequence
  Synthetic
uuggaugucaaaaggcacug

SEQ ID NO: 13647 - RNA, 21 nt, Artificial Sequence
  Synthetic
uuuggaugucaaaaggcacug

SEQ ID NO: 13648 - RNA, 22 nt, Artificial Sequence
  Synthetic
uuuuggaugucaaaaggcacug

SEQ ID NO: 13649 - RNA, 23 nt, Artificial Sequence
  Synthetic
auuuuggaugucaaaaggcacug

SEQ ID NO: 13650 - RNA, 24 nt, Artificial Sequence
  Synthetic
uauuuuggaugucaaaaggcacug

SEQ ID NO: 13651 - RNA, 18 nt, Artificial Sequence
  Synthetic
uuuuagaguccgcgugug

SEQ ID NO: 13652 - RNA, 19 nt, Artificial Sequence
  Synthetic
auuuuagaguccgcgugug

SEQ ID NO: 13653 - RNA, 20 nt, Artificial Sequence
  Synthetic
cauuuuagaguccgcgugug

SEQ ID NO: 13654 - RNA, 21 nt, Artificial Sequence
  Synthetic
ucauuuuagaguccgcgugug

SEQ ID NO: 13655 - RNA, 22 nt, Artificial Sequence
  Synthetic
uucauuuuagaguccgcgugug

SEQ ID NO: 13656 - RNA, 23 nt, Artificial Sequence
  Synthetic
uuucauuuuagaguccgcgugug

SEQ ID NO: 13657 - RNA, 24 nt, Artificial Sequence
  Synthetic
cuuucauuuuagaguccgcgugug

SEQ ID NO: 13658 - RNA, 18 nt, Artificial Sequence
  Synthetic
uuagaguccgcgugugug

SEQ ID NO: 13659 - RNA, 19 nt, Artificial Sequence
  Synthetic
uuuagaguccgcgugugug

SEQ ID NO: 13660 - RNA, 20 nt, Artificial Sequence
  Synthetic
uuuuagaguccgcgugugug

SEQ ID NO: 13661 - RNA, 21 nt, Artificial Sequence
  Synthetic
auuuuagaguccgcgugugug

SEQ ID NO: 13662 - RNA, 22 nt, Artificial Sequence
  Synthetic
cauuuuagaguccgcgugugug

SEQ ID NO: 13663 - RNA, 23 nt, Artificial Sequence
  Synthetic
ucauuuuagaguccgcgugugug

SEQ ID NO: 13664 - RNA, 24 nt, Artificial Sequence
  Synthetic
uucauuuuagaguccgcgugugug

SEQ ID NO: 13665 - RNA, 18 nt, Artificial Sequence
  Synthetic
aaaaaacccucaucccau

SEQ ID NO: 13666 - RNA, 19 nt, Artificial Sequence
  Synthetic
gaaaaaacccucaucccau

SEQ ID NO: 13667 - RNA, 20 nt, Artificial Sequence
  Synthetic
ggaaaaaacccucaucccau

SEQ ID NO: 13668 - RNA, 21 nt, Artificial Sequence
  Synthetic
gggaaaaaacccucaucccau

SEQ ID NO: 13669 - RNA, 22 nt, Artificial Sequence
  Synthetic
ggggaaaaaacccucaucccau

SEQ ID NO: 13670 - RNA, 23 nt, Artificial Sequence
  Synthetic
gggggaaaaaacccucaucccau

SEQ ID NO: 13671 - RNA, 24 nt, Artificial Sequence
  Synthetic
agggggaaaaaacccucaucccau

SEQ ID NO: 13672 - RNA, 18 nt, Artificial Sequence
  Synthetic
uaacccggcucucccgau

SEQ ID NO: 13673 - RNA, 19 nt, Artificial Sequence
  Synthetic
cuaacccggcucucccgau

SEQ ID NO: 13674 - RNA, 20 nt, Artificial Sequence
  Synthetic
ucuaacccggcucucccgau

SEQ ID NO: 13675 - RNA, 21 nt, Artificial Sequence
  Synthetic
uucuaacccggcucucccgau

SEQ ID NO: 13676 - RNA, 22 nt, Artificial Sequence
  Synthetic
uuucuaacccggcucucccgau

SEQ ID NO: 13677 - RNA, 23 nt, Artificial Sequence
  Synthetic
cuuucuaacccggcucucccgau

SEQ ID NO: 13678 - RNA, 24 nt, Artificial Sequence
  Synthetic
ucuuucuaacccggcucucccgau

SEQ ID NO: 13679 - RNA, 18 nt, Artificial Sequence
  Synthetic
uuuucacgagaaaaaccu

SEQ ID NO: 13680 - RNA, 19 nt, Artificial Sequence
  Synthetic
uuuuucacgagaaaaaccu

SEQ ID NO: 13681 - RNA, 20 nt, Artificial Sequence
  Synthetic
auuuuucacgagaaaaaccu

SEQ ID NO: 13682 - RNA, 21 nt, Artificial Sequence
  Synthetic
aauuuuucacgagaaaaaccu

SEQ ID NO: 13683 - RNA, 22 nt, Artificial Sequence
  Synthetic
aaauuuuucacgagaaaaaccu

SEQ ID NO: 13684 - RNA, 23 nt, Artificial Sequence
  Synthetic
uaaauuuuucacgagaaaaaccu

SEQ ID NO: 13685 - RNA, 24 nt, Artificial Sequence
  Synthetic
uuaaauuuuucacgagaaaaaccu

SEQ ID NO: 13686 - RNA, 18 nt, Artificial Sequence
  Synthetic
gcacuugaacuugcagcu

SEQ ID NO: 13687 - RNA, 19 nt, Artificial Sequence
  Synthetic
cgcacuugaacuugcagcu

SEQ ID NO: 13688 - RNA, 20 nt, Artificial Sequence
  Synthetic
ccgcacuugaacuugcagcu

SEQ ID NO: 13689 - RNA, 21 nt, Artificial Sequence
  Synthetic
uccgcacuugaacuugcagcu

SEQ ID NO: 13690 - RNA, 22 nt, Artificial Sequence
  Synthetic
guccgcacuugaacuugcagcu

SEQ ID NO: 13691 - RNA, 23 nt, Artificial Sequence
  Synthetic
cguccgcacuugaacuugcagcu

SEQ ID NO: 13692 - RNA, 24 nt, Artificial Sequence
  Synthetic
acguccgcacuugaacuugcagcu

SEQ ID NO: 13693 - RNA, 18 nt, Artificial Sequence
  Synthetic
cugaugaagauauuuucu

SEQ ID NO: 13694 - RNA, 19 nt, Artificial Sequence
  Synthetic
acugaugaagauauuuucu

SEQ ID NO: 13695 - RNA, 20 nt, Artificial Sequence
  Synthetic
cacugaugaagauauuuucu

SEQ ID NO: 13696 - RNA, 21 nt, Artificial Sequence
  Synthetic
gcacugaugaagauauuuucu

SEQ ID NO: 13697 - RNA, 22 nt, Artificial Sequence
  Synthetic
ggcacugaugaagauauuuucu

SEQ ID NO: 13698 - RNA, 23 nt, Artificial Sequence
  Synthetic
aggcacugaugaagauauuuucu

SEQ ID NO: 13699 - RNA, 24 nt, Artificial Sequence
  Synthetic
aaggcacugaugaagauauuuucu

SEQ ID NO: 13700 - RNA, 18 nt, Artificial Sequence
  Synthetic
ugauguguguccauuggu

SEQ ID NO: 13701 - RNA, 19 nt, Artificial Sequence
  Synthetic
cugauguguguccauuggu

SEQ ID NO: 13702 - RNA, 20 nt, Artificial Sequence
  Synthetic
ccugauguguguccauuggu

SEQ ID NO: 13703 - RNA, 21 nt, Artificial Sequence
  Synthetic
cccugauguguguccauuggu

SEQ ID NO: 13704 - RNA, 22 nt, Artificial Sequence
  Synthetic
ccccugauguguguccauuggu

SEQ ID NO: 13705 - RNA, 23 nt, Artificial Sequence
  Synthetic
gccccugauguguguccauuggu

SEQ ID NO: 13706 - RNA, 24 nt, Artificial Sequence
  Synthetic
agccccugauguguguccauuggu

SEQ ID NO: 13707 - RNA, 18 nt, Artificial Sequence
  Synthetic
auuuuagaguccgcgugu

SEQ ID NO: 13708 - RNA, 19 nt, Artificial Sequence
  Synthetic
cauuuuagaguccgcgugu

SEQ ID NO: 13709 - RNA, 20 nt, Artificial Sequence
  Synthetic
ucauuuuagaguccgcgugu

SEQ ID NO: 13710 - RNA, 21 nt, Artificial Sequence
  Synthetic
uucauuuuagaguccgcgugu

SEQ ID NO: 13711 - RNA, 22 nt, Artificial Sequence
  Synthetic
uuucauuuuagaguccgcgugu

SEQ ID NO: 13712 - RNA, 23 nt, Artificial Sequence
  Synthetic
cuuucauuuuagaguccgcgugu

SEQ ID NO: 13713 - RNA, 24 nt, Artificial Sequence
  Synthetic
ucuuucauuuuagaguccgcgugu

SEQ ID NO: 13714 - RNA, 18 nt, Artificial Sequence
  Synthetic
uuuagaguccgcgugugu

SEQ ID NO: 13715 - RNA, 19 nt, Artificial Sequence
  Synthetic
uuuuagaguccgcgugugu

SEQ ID NO: 13716 - RNA, 20 nt, Artificial Sequence
  Synthetic
auuuuagaguccgcgugugu

SEQ ID NO: 13717 - RNA, 21 nt, Artificial Sequence
  Synthetic
cauuuuagaguccgcgugugu

SEQ ID NO: 13718 - RNA, 22 nt, Artificial Sequence
  Synthetic
ucauuuuagaguccgcgugugu

SEQ ID NO: 13719 - RNA, 23 nt, Artificial Sequence
  Synthetic
uucauuuuagaguccgcgugugu

SEQ ID NO: 13720 - RNA, 24 nt, Artificial Sequence
  Synthetic
uuucauuuuagaguccgcgugugu

SEQ ID NO: 13721 - RNA, 18 nt, Artificial Sequence
  Synthetic
auugccguguaugcacuu

SEQ ID NO: 13722 - RNA, 19 nt, Artificial Sequence
  Synthetic
cauugccguguaugcacuu

SEQ ID NO: 13723 - RNA, 20 nt, Artificial Sequence
  Synthetic
ccauugccguguaugcacuu

SEQ ID NO: 13724 - RNA, 21 nt, Artificial Sequence
  Synthetic
accauugccguguaugcacuu

SEQ ID NO: 13725 - RNA, 22 nt, Artificial Sequence
  Synthetic
aaccauugccguguaugcacuu

SEQ ID NO: 13726 - RNA, 23 nt, Artificial Sequence
  Synthetic
gaaccauugccguguaugcacuu

SEQ ID NO: 13727 - RNA, 24 nt, Artificial Sequence
  Synthetic
ggaaccauugccguguaugcacuu

SEQ ID NO: 13728 - RNA, 18 nt, Artificial Sequence
  Synthetic
cucaccucuuuucucccc

SEQ ID NO: 13729 - RNA, 19 nt, Artificial Sequence
  Synthetic
ucucaccucuuuucucccc

SEQ ID NO: 13730 - RNA, 20 nt, Artificial Sequence
  Synthetic
gucucaccucuuuucucccc

SEQ ID NO: 13731 - RNA, 21 nt, Artificial Sequence
  Synthetic
agucucaccucuuuucucccc

SEQ ID NO: 13732 - RNA, 22 nt, Artificial Sequence
  Synthetic
cagucucaccucuuuucucccc

SEQ ID NO: 13733 - RNA, 23 nt, Artificial Sequence
  Synthetic
ccagucucaccucuuuucucccc

SEQ ID NO: 13734 - RNA, 24 nt, Artificial Sequence
  Synthetic
gccagucucaccucuuuucucccc

SEQ ID NO: 13735 - RNA, 18 nt, Artificial Sequence
  Synthetic
aaaagaaaaaaauagagc

SEQ ID NO: 13736 - RNA, 19 nt, Artificial Sequence
  Synthetic
aaaaagaaaaaaauagagc

SEQ ID NO: 13737 - RNA, 20 nt, Artificial Sequence
  Synthetic
aaaaaagaaaaaaauagagc

SEQ ID NO: 13738 - RNA, 21 nt, Artificial Sequence
  Synthetic
caaaaaagaaaaaaauagagc

SEQ ID NO: 13739 - RNA, 22 nt, Artificial Sequence
  Synthetic
ucaaaaaagaaaaaaauagagc

SEQ ID NO: 13740 - RNA, 23 nt, Artificial Sequence
  Synthetic
uucaaaaaagaaaaaaauagagc

SEQ ID NO: 13741 - RNA, 24 nt, Artificial Sequence
  Synthetic
auucaaaaaagaaaaaaauagagc

SEQ ID NO: 13742 - RNA, 18 nt, Artificial Sequence
  Synthetic
ggcggggcggggggggag

SEQ ID NO: 13743 - RNA, 19 nt, Artificial Sequence
  Synthetic
uggcggggcggggggggag

SEQ ID NO: 13744 - RNA, 20 nt, Artificial Sequence
  Synthetic
cuggcggggcggggggggag

SEQ ID NO: 13745 - RNA, 21 nt, Artificial Sequence
  Synthetic
acuggcggggcggggggggag

SEQ ID NO: 13746 - RNA, 22 nt, Artificial Sequence
  Synthetic
aacuggcggggcggggggggag

SEQ ID NO: 13747 - RNA, 23 nt, Artificial Sequence
  Synthetic
aaacuggcggggcggggggggag

SEQ ID NO: 13748 - RNA, 24 nt, Artificial Sequence
  Synthetic
aaaacuggcggggcggggggggag

SEQ ID NO: 13749 - RNA, 18 nt, Artificial Sequence
  Synthetic
agggagcgcacggcaacg

SEQ ID NO: 13750 - RNA, 19 nt, Artificial Sequence
  Synthetic
gagggagcgcacggcaacg

SEQ ID NO: 13751 - RNA, 20 nt, Artificial Sequence
  Synthetic
ggagggagcgcacggcaacg

SEQ ID NO: 13752 - RNA, 21 nt, Artificial Sequence
  Synthetic
gggagggagcgcacggcaacg

SEQ ID NO: 13753 - RNA, 22 nt, Artificial Sequence
  Synthetic
ugggagggagcgcacggcaacg

SEQ ID NO: 13754 - RNA, 23 nt, Artificial Sequence
  Synthetic
gugggagggagcgcacggcaacg

SEQ ID NO: 13755 - RNA, 24 nt, Artificial Sequence
  Synthetic
ggugggagggagcgcacggcaacg

SEQ ID NO: 13756 - RNA, 18 nt, Artificial Sequence
  Synthetic
cccccccauuuucuuacg

SEQ ID NO: 13757 - RNA, 19 nt, Artificial Sequence
  Synthetic
acccccccauuuucuuacg

SEQ ID NO: 13758 - RNA, 20 nt, Artificial Sequence
  Synthetic
uacccccccauuuucuuacg

SEQ ID NO: 13759 - RNA, 21 nt, Artificial Sequence
  Synthetic
cuacccccccauuuucuuacg

SEQ ID NO: 13760 - RNA, 22 nt, Artificial Sequence
  Synthetic
ccuacccccccauuuucuuacg

SEQ ID NO: 13761 - RNA, 23 nt, Artificial Sequence
  Synthetic
cccuacccccccauuuucuuacg

SEQ ID NO: 13762 - RNA, 24 nt, Artificial Sequence
  Synthetic
ucccuacccccccauuuucuuacg

SEQ ID NO: 13763 - RNA, 18 nt, Artificial Sequence
  Synthetic
gggcggagggaagccagg

SEQ ID NO: 13764 - RNA, 19 nt, Artificial Sequence
  Synthetic
cgggcggagggaagccagg

SEQ ID NO: 13765 - RNA, 20 nt, Artificial Sequence
  Synthetic
gcgggcggagggaagccagg

SEQ ID NO: 13766 - RNA, 21 nt, Artificial Sequence
  Synthetic
cgcgggcggagggaagccagg

SEQ ID NO: 13767 - RNA, 22 nt, Artificial Sequence
  Synthetic
gcgcgggcggagggaagccagg

SEQ ID NO: 13768 - RNA, 23 nt, Artificial Sequence
  Synthetic
agcgcgggcggagggaagccagg

SEQ ID NO: 13769 - RNA, 24 nt, Artificial Sequence
  Synthetic
aagcgcgggcggagggaagccagg

SEQ ID NO: 13770 - RNA, 18 nt, Artificial Sequence
  Synthetic
cggaaaggaggaaagagg

SEQ ID NO: 13771 - RNA, 19 nt, Artificial Sequence
  Synthetic
gcggaaaggaggaaagagg

SEQ ID NO: 13772 - RNA, 20 nt, Artificial Sequence
  Synthetic
ggcggaaaggaggaaagagg

SEQ ID NO: 13773 - RNA, 21 nt, Artificial Sequence
  Synthetic
cggcggaaaggaggaaagagg

SEQ ID NO: 13774 - RNA, 22 nt, Artificial Sequence
  Synthetic
gcggcggaaaggaggaaagagg

SEQ ID NO: 13775 - RNA, 23 nt, Artificial Sequence
  Synthetic
agcggcggaaaggaggaaagagg

SEQ ID NO: 13776 - RNA, 24 nt, Artificial Sequence
  Synthetic
aagcggcggaaaggaggaaagagg

SEQ ID NO: 13777 - RNA, 18 nt, Artificial Sequence
  Synthetic
aaacuggcggggcggggg

SEQ ID NO: 13778 - RNA, 19 nt, Artificial Sequence
  Synthetic
aaaacuggcggggcggggg

SEQ ID NO: 13779 - RNA, 20 nt, Artificial Sequence
  Synthetic
caaaacuggcggggcggggg

SEQ ID NO: 13780 - RNA, 21 nt, Artificial Sequence
  Synthetic
gcaaaacuggcggggcggggg

SEQ ID NO: 13781 - RNA, 22 nt, Artificial Sequence
  Synthetic
ugcaaaacuggcggggcggggg

SEQ ID NO: 13782 - RNA, 23 nt, Artificial Sequence
  Synthetic
uugcaaaacuggcggggcggggg

SEQ ID NO: 13783 - RNA, 24 nt, Artificial Sequence
  Synthetic
uuugcaaaacuggcggggcggggg

SEQ ID NO: 13784 - RNA, 18 nt, Artificial Sequence
  Synthetic
ccacccccagguuugcau

SEQ ID NO: 13785 - RNA, 19 nt, Artificial Sequence
  Synthetic
cccacccccagguuugcau

SEQ ID NO: 13786 - RNA, 20 nt, Artificial Sequence
  Synthetic
ucccacccccagguuugcau

SEQ ID NO: 13787 - RNA, 21 nt, Artificial Sequence
  Synthetic
cucccacccccagguuugcau

SEQ ID NO: 13788 - RNA, 22 nt, Artificial Sequence
  Synthetic
gcucccacccccagguuugcau

SEQ ID NO: 13789 - RNA, 23 nt, Artificial Sequence
  Synthetic
agcucccacccccagguuugcau

SEQ ID NO: 13790 - RNA, 24 nt, Artificial Sequence
  Synthetic
cagcucccacccccagguuugcau

SEQ ID NO: 13791 - RNA, 18 nt, Artificial Sequence
  Synthetic
gccuaaguuuggagggcu

SEQ ID NO: 13792 - RNA, 19 nt, Artificial Sequence
  Synthetic
agccuaaguuuggagggcu

SEQ ID NO: 13793 - RNA, 20 nt, Artificial Sequence
  Synthetic
cagccuaaguuuggagggcu

SEQ ID NO: 13794 - RNA, 21 nt, Artificial Sequence
  Synthetic
ccagccuaaguuuggagggcu

SEQ ID NO: 13795 - RNA, 22 nt, Artificial Sequence
  Synthetic
uccagccuaaguuuggagggcu

SEQ ID NO: 13796 - RNA, 23 nt, Artificial Sequence
  Synthetic
auccagccuaaguuuggagggcu

SEQ ID NO: 13797 - RNA, 24 nt, Artificial Sequence
  Synthetic
aauccagccuaaguuuggagggcu

SEQ ID NO: 13798 - RNA, 18 nt, Artificial Sequence
  Synthetic
ccacuuucucacuauugu

SEQ ID NO: 13799 - RNA, 19 nt, Artificial Sequence
  Synthetic
gccacuuucucacuauugu

SEQ ID NO: 13800 - RNA, 20 nt, Artificial Sequence
  Synthetic
ugccacuuucucacuauugu

SEQ ID NO: 13801 - RNA, 21 nt, Artificial Sequence
  Synthetic
gugccacuuucucacuauugu

SEQ ID NO: 13802 - RNA, 22 nt, Artificial Sequence
  Synthetic
agugccacuuucucacuauugu

SEQ ID NO: 13803 - RNA, 23 nt, Artificial Sequence
  Synthetic
cagugccacuuucucacuauugu

SEQ ID NO: 13804 - RNA, 24 nt, Artificial Sequence
  Synthetic
acagugccacuuucucacuauugu

SEQ ID NO: 13805 - RNA, 18 nt, Artificial Sequence
  Synthetic
uuauuucucuuuucgaaa

SEQ ID NO: 13806 - RNA, 19 nt, Artificial Sequence
  Synthetic
uuuauuucucuuuucgaaa

SEQ ID NO: 13807 - RNA, 20 nt, Artificial Sequence
  Synthetic
cuuuauuucucuuuucgaaa

SEQ ID NO: 13808 - RNA, 21 nt, Artificial Sequence
  Synthetic
gcuuuauuucucuuuucgaaa

SEQ ID NO: 13809 - RNA, 22 nt, Artificial Sequence
  Synthetic
cgcuuuauuucucuuuucgaaa

SEQ ID NO: 13810 - RNA, 23 nt, Artificial Sequence
  Synthetic
ccgcuuuauuucucuuuucgaaa

SEQ ID NO: 13811 - RNA, 24 nt, Artificial Sequence
  Synthetic
gccgcuuuauuucucuuuucgaaa

SEQ ID NO: 13812 - RNA, 18 nt, Artificial Sequence
  Synthetic
cggcggcggggaggggaa

SEQ ID NO: 13813 - RNA, 19 nt, Artificial Sequence
  Synthetic
gcggcggcggggaggggaa

SEQ ID NO: 13814 - RNA, 20 nt, Artificial Sequence
  Synthetic
ggcggcggcggggaggggaa

SEQ ID NO: 13815 - RNA, 21 nt, Artificial Sequence
  Synthetic
cggcggcggcggggaggggaa

SEQ ID NO: 13816 - RNA, 22 nt, Artificial Sequence
  Synthetic
gcggcggcggcggggaggggaa

SEQ ID NO: 13817 - RNA, 23 nt, Artificial Sequence
  Synthetic
cgcggcggcggcggggaggggaa

SEQ ID NO: 13818 - RNA, 24 nt, Artificial Sequence
  Synthetic
gcgcggcggcggcggggaggggaa

SEQ ID NO: 13819 - RNA, 18 nt, Artificial Sequence
  Synthetic
uggggggguagggaggga

SEQ ID NO: 13820 - RNA, 19 nt, Artificial Sequence
  Synthetic
auggggggguagggaggga

SEQ ID NO: 13821 - RNA, 20 nt, Artificial Sequence
  Synthetic
aauggggggguagggaggga

SEQ ID NO: 13822 - RNA, 21 nt, Artificial Sequence
  Synthetic
aaauggggggguagggaggga

SEQ ID NO: 13823 - RNA, 22 nt, Artificial Sequence
  Synthetic
aaaauggggggguagggaggga

SEQ ID NO: 13824 - RNA, 23 nt, Artificial Sequence
  Synthetic
gaaaauggggggguagggaggga

SEQ ID NO: 13825 - RNA, 24 nt, Artificial Sequence
  Synthetic
agaaaauggggggguagggaggga

SEQ ID NO: 13826 - RNA, 18 nt, Artificial Sequence
  Synthetic
aaaauggggggguaggga

SEQ ID NO: 13827 - RNA, 19 nt, Artificial Sequence
  Synthetic
gaaaauggggggguaggga

SEQ ID NO: 13828 - RNA, 20 nt, Artificial Sequence
  Synthetic
agaaaauggggggguaggga

SEQ ID NO: 13829 - RNA, 21 nt, Artificial Sequence
  Synthetic
aagaaaauggggggguaggga

SEQ ID NO: 13830 - RNA, 22 nt, Artificial Sequence
  Synthetic
uaagaaaauggggggguaggga

SEQ ID NO: 13831 - RNA, 23 nt, Artificial Sequence
  Synthetic
guaagaaaauggggggguaggga

SEQ ID NO: 13832 - RNA, 24 nt, Artificial Sequence
  Synthetic
cguaagaaaauggggggguaggga

SEQ ID NO: 13833 - RNA, 18 nt, Artificial Sequence
  Synthetic
aaggggcccccggcgcuc

SEQ ID NO: 13834 - RNA, 19 nt, Artificial Sequence
  Synthetic
aaaggggcccccggcgcuc

SEQ ID NO: 13835 - RNA, 20 nt, Artificial Sequence
  Synthetic
gaaaggggcccccggcgcuc

SEQ ID NO: 13836 - RNA, 21 nt, Artificial Sequence
  Synthetic
ggaaaggggcccccggcgcuc

SEQ ID NO: 13837 - RNA, 22 nt, Artificial Sequence
  Synthetic
uggaaaggggcccccggcgcuc

SEQ ID NO: 13838 - RNA, 23 nt, Artificial Sequence
  Synthetic
guggaaaggggcccccggcgcuc

SEQ ID NO: 13839 - RNA, 24 nt, Artificial Sequence
  Synthetic
uguggaaaggggcccccggcgcuc

SEQ ID NO: 13840 - RNA, 18 nt, Artificial Sequence
  Synthetic
cuuuuguuccggccagag

SEQ ID NO: 13841 - RNA, 19 nt, Artificial Sequence
  Synthetic
ccuuuuguuccggccagag

SEQ ID NO: 13842 - RNA, 20 nt, Artificial Sequence
  Synthetic
gccuuuuguuccggccagag

SEQ ID NO: 13843 - RNA, 21 nt, Artificial Sequence
  Synthetic
cgccuuuuguuccggccagag

SEQ ID NO: 13844 - RNA, 22 nt, Artificial Sequence
  Synthetic
ccgccuuuuguuccggccagag

SEQ ID NO: 13845 - RNA, 23 nt, Artificial Sequence
  Synthetic
gccgccuuuuguuccggccagag

SEQ ID NO: 13846 - RNA, 24 nt, Artificial Sequence
  Synthetic
ugccgccuuuuguuccggccagag

SEQ ID NO: 13847 - RNA, 18 nt, Artificial Sequence
  Synthetic
gugggugugcguacggag

SEQ ID NO: 13848 - RNA, 19 nt, Artificial Sequence
  Synthetic
agugggugugcguacggag

SEQ ID NO: 13849 - RNA, 20 nt, Artificial Sequence
  Synthetic
aagugggugugcguacggag

SEQ ID NO: 13850 - RNA, 21 nt, Artificial Sequence
  Synthetic
gaagugggugugcguacggag

SEQ ID NO: 13851 - RNA, 22 nt, Artificial Sequence
  Synthetic
ggaagugggugugcguacggag

SEQ ID NO: 13852 - RNA, 23 nt, Artificial Sequence
  Synthetic
gggaagugggugugcguacggag

SEQ ID NO: 13853 - RNA, 24 nt, Artificial Sequence
  Synthetic
ggggaagugggugugcguacggag

SEQ ID NO: 13854 - RNA, 18 nt, Artificial Sequence
  Synthetic
ccggcgcuccugaguccg

SEQ ID NO: 13855 - RNA, 19 nt, Artificial Sequence
  Synthetic
cccggcgcuccugaguccg

SEQ ID NO: 13856 - RNA, 20 nt, Artificial Sequence
  Synthetic
ccccggcgcuccugaguccg

SEQ ID NO: 13857 - RNA, 21 nt, Artificial Sequence
  Synthetic
cccccggcgcuccugaguccg

SEQ ID NO: 13858 - RNA, 22 nt, Artificial Sequence
  Synthetic
gcccccggcgcuccugaguccg

SEQ ID NO: 13859 - RNA, 23 nt, Artificial Sequence
  Synthetic
ggcccccggcgcuccugaguccg

SEQ ID NO: 13860 - RNA, 24 nt, Artificial Sequence
  Synthetic
gggcccccggcgcuccugaguccg

SEQ ID NO: 13861 - RNA, 18 nt, Artificial Sequence
  Synthetic
cagcccuccaaacuuagg

SEQ ID NO: 13862 - RNA, 19 nt, Artificial Sequence
  Synthetic
gcagcccuccaaacuuagg

SEQ ID NO: 13863 - RNA, 20 nt, Artificial Sequence
  Synthetic
cgcagcccuccaaacuuagg

SEQ ID NO: 13864 - RNA, 21 nt, Artificial Sequence
  Synthetic
ccgcagcccuccaaacuuagg

SEQ ID NO: 13865 - RNA, 22 nt, Artificial Sequence
  Synthetic
cccgcagcccuccaaacuuagg

SEQ ID NO: 13866 - RNA, 23 nt, Artificial Sequence
  Synthetic
acccgcagcccuccaaacuuagg

SEQ ID NO: 13867 - RNA, 24 nt, Artificial Sequence
  Synthetic
gacccgcagcccuccaaacuuagg

SEQ ID NO: 13868 - RNA, 18 nt, Artificial Sequence
  Synthetic
cucaccguaagaaaaugg

SEQ ID NO: 13869 - RNA, 19 nt, Artificial Sequence
  Synthetic
acucaccguaagaaaaugg

SEQ ID NO: 13870 - RNA, 20 nt, Artificial Sequence
  Synthetic
cacucaccguaagaaaaugg

SEQ ID NO: 13871 - RNA, 21 nt, Artificial Sequence
  Synthetic
ccacucaccguaagaaaaugg

SEQ ID NO: 13872 - RNA, 22 nt, Artificial Sequence
  Synthetic
cccacucaccguaagaaaaugg

SEQ ID NO: 13873 - RNA, 23 nt, Artificial Sequence
  Synthetic
ucccacucaccguaagaaaaugg

SEQ ID NO: 13874 - RNA, 24 nt, Artificial Sequence
  Synthetic
uucccacucaccguaagaaaaugg

SEQ ID NO: 13875 - RNA, 18 nt, Artificial Sequence
  Synthetic
gaggcucagcucucaacu

SEQ ID NO: 13876 - RNA, 19 nt, Artificial Sequence
  Synthetic
ggaggcucagcucucaacu

SEQ ID NO: 13877 - RNA, 20 nt, Artificial Sequence
  Synthetic
uggaggcucagcucucaacu

SEQ ID NO: 13878 - RNA, 21 nt, Artificial Sequence
  Synthetic
uuggaggcucagcucucaacu

SEQ ID NO: 13879 - RNA, 22 nt, Artificial Sequence
  Synthetic
cuuggaggcucagcucucaacu

SEQ ID NO: 13880 - RNA, 23 nt, Artificial Sequence
  Synthetic
acuuggaggcucagcucucaacu

SEQ ID NO: 13881 - RNA, 24 nt, Artificial Sequence
  Synthetic
aacuuggaggcucagcucucaacu

SEQ ID NO: 13882 - RNA, 18 nt, Artificial Sequence
  Synthetic
caacucacaugcaaaccu

SEQ ID NO: 13883 - RNA, 19 nt, Artificial Sequence
  Synthetic
acaacucacaugcaaaccu

SEQ ID NO: 13884 - RNA, 20 nt, Artificial Sequence
  Synthetic
aacaacucacaugcaaaccu

SEQ ID NO: 13885 - RNA, 21 nt, Artificial Sequence
  Synthetic
gaacaacucacaugcaaaccu

SEQ ID NO: 13886 - RNA, 22 nt, Artificial Sequence
  Synthetic
cgaacaacucacaugcaaaccu

SEQ ID NO: 13887 - RNA, 23 nt, Artificial Sequence
  Synthetic
gcgaacaacucacaugcaaaccu

SEQ ID NO: 13888 - RNA, 24 nt, Artificial Sequence
  Synthetic
ugcgaacaacucacaugcaaaccu

SEQ ID NO: 13889 - RNA, 18 nt, Artificial Sequence
  Synthetic
uugaauaaucuuucauuu

SEQ ID NO: 13890 - RNA, 19 nt, Artificial Sequence
  Synthetic
uuugaauaaucuuucauuu

SEQ ID NO: 13891 - RNA, 20 nt, Artificial Sequence
  Synthetic
uuuugaauaaucuuucauuu

SEQ ID NO: 13892 - RNA, 21 nt, Artificial Sequence
  Synthetic
uuuuugaauaaucuuucauuu

SEQ ID NO: 13893 - RNA, 22 nt, Artificial Sequence
  Synthetic
uuuuuugaauaaucuuucauuu

SEQ ID NO: 13894 - RNA, 23 nt, Artificial Sequence
  Synthetic
cuuuuuugaauaaucuuucauuu

SEQ ID NO: 13895 - RNA, 24 nt, Artificial Sequence
  Synthetic
ucuuuuuugaauaaucuuucauuu

SEQ ID NO: 13896 - RNA, 18 nt, Artificial Sequence
  Synthetic
gcucuauuuuuuucuuuu

SEQ ID NO: 13897 - RNA, 19 nt, Artificial Sequence
  Synthetic
cgcucuauuuuuuucuuuu

SEQ ID NO: 13898 - RNA, 20 nt, Artificial Sequence
  Synthetic
ucgcucuauuuuuuucuuuu

SEQ ID NO: 13899 - RNA, 21 nt, Artificial Sequence
  Synthetic
cucgcucuauuuuuuucuuuu

SEQ ID NO: 13900 - RNA, 22 nt, Artificial Sequence
  Synthetic
ucucgcucuauuuuuuucuuuu

SEQ ID NO: 13901 - RNA, 23 nt, Artificial Sequence
  Synthetic
cucucgcucuauuuuuuucuuuu

SEQ ID NO: 13902 - RNA, 24 nt, Artificial Sequence
  Synthetic
acucucgcucuauuuuuuucuuuu

SEQ ID NO: 13903 - RNA, 18 nt, Artificial Sequence
  Synthetic
auucaaaaaagaaaaaaa

SEQ ID NO: 13904 - RNA, 19 nt, Artificial Sequence
  Synthetic
uauucaaaaaagaaaaaaa

SEQ ID NO: 13905 - RNA, 20 nt, Artificial Sequence
  Synthetic
uuauucaaaaaagaaaaaaa

SEQ ID NO: 13906 - RNA, 21 nt, Artificial Sequence
  Synthetic
auuauucaaaaaagaaaaaaa

SEQ ID NO: 13907 - RNA, 22 nt, Artificial Sequence
  Synthetic
gauuauucaaaaaagaaaaaaa

SEQ ID NO: 13908 - RNA, 23 nt, Artificial Sequence
  Synthetic
agauuauucaaaaaagaaaaaaa

SEQ ID NO: 13909 - RNA, 24 nt, Artificial Sequence
  Synthetic
aagauuauucaaaaaagaaaaaaa

SEQ ID NO: 13910 - RNA, 18 nt, Artificial Sequence
  Synthetic
augaaagauuauucaaaa

SEQ ID NO: 13911 - RNA, 19 nt, Artificial Sequence
  Synthetic
aaugaaagauuauucaaaa

SEQ ID NO: 13912 - RNA, 20 nt, Artificial Sequence
  Synthetic
aaaugaaagauuauucaaaa

SEQ ID NO: 13913 - RNA, 21 nt, Artificial Sequence
  Synthetic
aaaaugaaagauuauucaaaa

SEQ ID NO: 13914 - RNA, 22 nt, Artificial Sequence
  Synthetic
uaaaaugaaagauuauucaaaa

SEQ ID NO: 13915 - RNA, 23 nt, Artificial Sequence
  Synthetic
cuaaaaugaaagauuauucaaaa

SEQ ID NO: 13916 - RNA, 24 nt, Artificial Sequence
  Synthetic
ucuaaaaugaaagauuauucaaaa

SEQ ID NO: 13917 - RNA, 18 nt, Artificial Sequence
  Synthetic
ugcauuccuuuucgaaaa

SEQ ID NO: 13918 - RNA, 19 nt, Artificial Sequence
  Synthetic
uugcauuccuuuucgaaaa

SEQ ID NO: 13919 - RNA, 20 nt, Artificial Sequence
  Synthetic
auugcauuccuuuucgaaaa

SEQ ID NO: 13920 - RNA, 21 nt, Artificial Sequence
  Synthetic
cauugcauuccuuuucgaaaa

SEQ ID NO: 13921 - RNA, 22 nt, Artificial Sequence
  Synthetic
ucauugcauuccuuuucgaaaa

SEQ ID NO: 13922 - RNA, 23 nt, Artificial Sequence
  Synthetic
aucauugcauuccuuuucgaaaa

SEQ ID NO: 13923 - RNA, 24 nt, Artificial Sequence
  Synthetic
aaucauugcauuccuuuucgaaaa

SEQ ID NO: 13924 - RNA, 18 nt, Artificial Sequence
  Synthetic
gcggcggaaaggaggaaa

SEQ ID NO: 13925 - RNA, 19 nt, Artificial Sequence
  Synthetic
agcggcggaaaggaggaaa

SEQ ID NO: 13926 - RNA, 20 nt, Artificial Sequence
  Synthetic
aagcggcggaaaggaggaaa

SEQ ID NO: 13927 - RNA, 21 nt, Artificial Sequence
  Synthetic
aaagcggcggaaaggaggaaa

SEQ ID NO: 13928 - RNA, 22 nt, Artificial Sequence
  Synthetic
uaaagcggcggaaaggaggaaa

SEQ ID NO: 13929 - RNA, 23 nt, Artificial Sequence
  Synthetic
auaaagcggcggaaaggaggaaa

SEQ ID NO: 13930 - RNA, 24 nt, Artificial Sequence
  Synthetic
aauaaagcggcggaaaggaggaaa

SEQ ID NO: 13931 - RNA, 18 nt, Artificial Sequence
  Synthetic
gcccgcgcggccuggaaa

SEQ ID NO: 13932 - RNA, 19 nt, Artificial Sequence
  Synthetic
agcccgcgcggccuggaaa

SEQ ID NO: 13933 - RNA, 20 nt, Artificial Sequence
  Synthetic
gagcccgcgcggccuggaaa

SEQ ID NO: 13934 - RNA, 21 nt, Artificial Sequence
  Synthetic
ggagcccgcgcggccuggaaa

SEQ ID NO: 13935 - RNA, 22 nt, Artificial Sequence
  Synthetic
aggagcccgcgcggccuggaaa

SEQ ID NO: 13936 - RNA, 23 nt, Artificial Sequence
  Synthetic
caggagcccgcgcggccuggaaa

SEQ ID NO: 13937 - RNA, 24 nt, Artificial Sequence
  Synthetic
ccaggagcccgcgcggccuggaaa

SEQ ID NO: 13938 - RNA, 18 nt, Artificial Sequence
  Synthetic
acacacgcggacucuaaa

SEQ ID NO: 13939 - RNA, 19 nt, Artificial Sequence
  Synthetic
cacacacgcggacucuaaa

SEQ ID NO: 13940 - RNA, 20 nt, Artificial Sequence
  Synthetic
ccacacacgcggacucuaaa

SEQ ID NO: 13941 - RNA, 21 nt, Artificial Sequence
  Synthetic
cccacacacgcggacucuaaa

SEQ ID NO: 13942 - RNA, 22 nt, Artificial Sequence
  Synthetic
ccccacacacgcggacucuaaa

SEQ ID NO: 13943 - RNA, 23 nt, Artificial Sequence
  Synthetic
cccccacacacgcggacucuaaa

SEQ ID NO: 13944 - RNA, 24 nt, Artificial Sequence
  Synthetic
ccccccacacacgcggacucuaaa

SEQ ID NO: 13945 - RNA, 18 nt, Artificial Sequence
  Synthetic
auugcauuccuuuucgaa

SEQ ID NO: 13946 - RNA, 19 nt, Artificial Sequence
  Synthetic
cauugcauuccuuuucgaa

SEQ ID NO: 13947 - RNA, 20 nt, Artificial Sequence
  Synthetic
ucauugcauuccuuuucgaa

SEQ ID NO: 13948 - RNA, 21 nt, Artificial Sequence
  Synthetic
aucauugcauuccuuuucgaa

SEQ ID NO: 13949 - RNA, 22 nt, Artificial Sequence
  Synthetic
aaucauugcauuccuuuucgaa

SEQ ID NO: 13950 - RNA, 23 nt, Artificial Sequence
  Synthetic
gaaucauugcauuccuuuucgaa

SEQ ID NO: 13951 - RNA, 24 nt, Artificial Sequence
  Synthetic
ggaaucauugcauuccuuuucgaa

SEQ ID NO: 13952 - RNA, 18 nt, Artificial Sequence
  Synthetic
agaaauaaagcggcggaa

SEQ ID NO: 13953 - RNA, 19 nt, Artificial Sequence
  Synthetic
gagaaauaaagcggcggaa

SEQ ID NO: 13954 - RNA, 20 nt, Artificial Sequence
  Synthetic
agagaaauaaagcggcggaa

SEQ ID NO: 13955 - RNA, 21 nt, Artificial Sequence
  Synthetic
aagagaaauaaagcggcggaa

SEQ ID NO: 13956 - RNA, 22 nt, Artificial Sequence
  Synthetic
aaagagaaauaaagcggcggaa

SEQ ID NO: 13957 - RNA, 23 nt, Artificial Sequence
  Synthetic
aaaagagaaauaaagcggcggaa

SEQ ID NO: 13958 - RNA, 24 nt, Artificial Sequence
  Synthetic
gaaaagagaaauaaagcggcggaa

SEQ ID NO: 13959 - RNA, 18 nt, Artificial Sequence
  Synthetic
cccgaggagaggacagca

SEQ ID NO: 13960 - RNA, 19 nt, Artificial Sequence
  Synthetic
gcccgaggagaggacagca

SEQ ID NO: 13961 - RNA, 20 nt, Artificial Sequence
  Synthetic
ugcccgaggagaggacagca

SEQ ID NO: 13962 - RNA, 21 nt, Artificial Sequence
  Synthetic
uugcccgaggagaggacagca

SEQ ID NO: 13963 - RNA, 22 nt, Artificial Sequence
  Synthetic
uuugcccgaggagaggacagca

SEQ ID NO: 13964 - RNA, 23 nt, Artificial Sequence
  Synthetic
cuuugcccgaggagaggacagca

SEQ ID NO: 13965 - RNA, 24 nt, Artificial Sequence
  Synthetic
acuuugcccgaggagaggacagca

SEQ ID NO: 13966 - RNA, 18 nt, Artificial Sequence
  Synthetic
ccaaguuacagcuccgca

SEQ ID NO: 13967 - RNA, 19 nt, Artificial Sequence
  Synthetic
uccaaguuacagcuccgca

SEQ ID NO: 13968 - RNA, 20 nt, Artificial Sequence
  Synthetic
cuccaaguuacagcuccgca

SEQ ID NO: 13969 - RNA, 21 nt, Artificial Sequence
  Synthetic
ccuccaaguuacagcuccgca

SEQ ID NO: 13970 - RNA, 22 nt, Artificial Sequence
  Synthetic
gccuccaaguuacagcuccgca

SEQ ID NO: 13971 - RNA, 23 nt, Artificial Sequence
  Synthetic
agccuccaaguuacagcuccgca

SEQ ID NO: 13972 - RNA, 24 nt, Artificial Sequence
  Synthetic
gagccuccaaguuacagcuccgca

SEQ ID NO: 13973 - RNA, 18 nt, Artificial Sequence
  Synthetic
gagccggcacaaaaggca

SEQ ID NO: 13974 - RNA, 19 nt, Artificial Sequence
  Synthetic
ggagccggcacaaaaggca

SEQ ID NO: 13975 - RNA, 20 nt, Artificial Sequence
  Synthetic
aggagccggcacaaaaggca

SEQ ID NO: 13976 - RNA, 21 nt, Artificial Sequence
  Synthetic
gaggagccggcacaaaaggca

SEQ ID NO: 13977 - RNA, 22 nt, Artificial Sequence
  Synthetic
cgaggagccggcacaaaaggca

SEQ ID NO: 13978 - RNA, 23 nt, Artificial Sequence
  Synthetic
gcgaggagccggcacaaaaggca

SEQ ID NO: 13979 - RNA, 24 nt, Artificial Sequence
  Synthetic
cgcgaggagccggcacaaaaggca

SEQ ID NO: 13980 - RNA, 18 nt, Artificial Sequence
  Synthetic
aaauagagcgagagugca

SEQ ID NO: 13981 - RNA, 19 nt, Artificial Sequence
  Synthetic
aaaauagagcgagagugca

SEQ ID NO: 13982 - RNA, 20 nt, Artificial Sequence
  Synthetic
aaaaauagagcgagagugca

SEQ ID NO: 13983 - RNA, 21 nt, Artificial Sequence
  Synthetic
aaaaaauagagcgagagugca

SEQ ID NO: 13984 - RNA, 22 nt, Artificial Sequence
  Synthetic
aaaaaaauagagcgagagugca

SEQ ID NO: 13985 - RNA, 23 nt, Artificial Sequence
  Synthetic
gaaaaaaauagagcgagagugca

SEQ ID NO: 13986 - RNA, 24 nt, Artificial Sequence
  Synthetic
agaaaaaaauagagcgagagugca

SEQ ID NO: 13987 - RNA, 18 nt, Artificial Sequence
  Synthetic
ccgcgcggccuggaaaga

SEQ ID NO: 13988 - RNA, 19 nt, Artificial Sequence
  Synthetic
cccgcgcggccuggaaaga

SEQ ID NO: 13989 - RNA, 20 nt, Artificial Sequence
  Synthetic
gcccgcgcggccuggaaaga

SEQ ID NO: 13990 - RNA, 21 nt, Artificial Sequence
  Synthetic
agcccgcgcggccuggaaaga

SEQ ID NO: 13991 - RNA, 22 nt, Artificial Sequence
  Synthetic
gagcccgcgcggccuggaaaga

SEQ ID NO: 13992 - RNA, 23 nt, Artificial Sequence
  Synthetic
ggagcccgcgcggccuggaaaga

SEQ ID NO: 13993 - RNA, 24 nt, Artificial Sequence
  Synthetic
aggagcccgcgcggccuggaaaga

SEQ ID NO: 13994 - RNA, 18 nt, Artificial Sequence
  Synthetic
aaaaaagaaaaaaauaga

SEQ ID NO: 13995 - RNA, 19 nt, Artificial Sequence
  Synthetic
caaaaaagaaaaaaauaga

SEQ ID NO: 13996 - RNA, 20 nt, Artificial Sequence
  Synthetic
ucaaaaaagaaaaaaauaga

SEQ ID NO: 13997 - RNA, 21 nt, Artificial Sequence
  Synthetic
uucaaaaaagaaaaaaauaga

SEQ ID NO: 13998 - RNA, 22 nt, Artificial Sequence
  Synthetic
auucaaaaaagaaaaaaauaga

SEQ ID NO: 13999 - RNA, 23 nt, Artificial Sequence
  Synthetic
uauucaaaaaagaaaaaaauaga

SEQ ID NO: 14000 - RNA, 24 nt, Artificial Sequence
  Synthetic
uuauucaaaaaagaaaaaaauaga

SEQ ID NO: 14001 - RNA, 18 nt, Artificial Sequence
  Synthetic
cagcuccgcagcgggcga

SEQ ID NO: 14002 - RNA, 19 nt, Artificial Sequence
  Synthetic
acagcuccgcagcgggcga

SEQ ID NO: 14003 - RNA, 20 nt, Artificial Sequence
  Synthetic
uacagcuccgcagcgggcga

SEQ ID NO: 14004 - RNA, 21 nt, Artificial Sequence
  Synthetic
uuacagcuccgcagcgggcga

SEQ ID NO: 14005 - RNA, 22 nt, Artificial Sequence
  Synthetic
guuacagcuccgcagcgggcga

SEQ ID NO: 14006 - RNA, 23 nt, Artificial Sequence
  Synthetic
aguuacagcuccgcagcgggcga

SEQ ID NO: 14007 - RNA, 24 nt, Artificial Sequence
  Synthetic
aaguuacagcuccgcagcgggcga

SEQ ID NO: 14008 - RNA, 18 nt, Artificial Sequence
  Synthetic
ggaaacuuugcccgagga

SEQ ID NO: 14009 - RNA, 19 nt, Artificial Sequence
  Synthetic
gggaaacuuugcccgagga

SEQ ID NO: 14010 - RNA, 20 nt, Artificial Sequence
  Synthetic
cgggaaacuuugcccgagga

SEQ ID NO: 14011 - RNA, 21 nt, Artificial Sequence
  Synthetic
ucgggaaacuuugcccgagga

SEQ ID NO: 14012 - RNA, 22 nt, Artificial Sequence
  Synthetic
cucgggaaacuuugcccgagga

SEQ ID NO: 14013 - RNA, 23 nt, Artificial Sequence
  Synthetic
gcucgggaaacuuugcccgagga

SEQ ID NO: 14014 - RNA, 24 nt, Artificial Sequence
  Synthetic
cgcucgggaaacuuugcccgagga

SEQ ID NO: 14015 - RNA, 18 nt, Artificial Sequence
  Synthetic
aagcggcggaaaggagga

SEQ ID NO: 14016 - RNA, 19 nt, Artificial Sequence
  Synthetic
aaagcggcggaaaggagga

SEQ ID NO: 14017 - RNA, 20 nt, Artificial Sequence
  Synthetic
uaaagcggcggaaaggagga

SEQ ID NO: 14018 - RNA, 21 nt, Artificial Sequence
  Synthetic
auaaagcggcggaaaggagga

SEQ ID NO: 14019 - RNA, 22 nt, Artificial Sequence
  Synthetic
aauaaagcggcggaaaggagga

SEQ ID NO: 14020 - RNA, 23 nt, Artificial Sequence
  Synthetic
aaauaaagcggcggaaaggagga

SEQ ID NO: 14021 - RNA, 24 nt, Artificial Sequence
  Synthetic
gaaauaaagcggcggaaaggagga

SEQ ID NO: 14022 - RNA, 18 nt, Artificial Sequence
  Synthetic
gagaaauaaagcggcgga

SEQ ID NO: 14023 - RNA, 19 nt, Artificial Sequence
  Synthetic
agagaaauaaagcggcgga

SEQ ID NO: 14024 - RNA, 20 nt, Artificial Sequence
  Synthetic
aagagaaauaaagcggcgga

SEQ ID NO: 14025 - RNA, 21 nt, Artificial Sequence
  Synthetic
aaagagaaauaaagcggcgga

SEQ ID NO: 14026 - RNA, 22 nt, Artificial Sequence
  Synthetic
aaaagagaaauaaagcggcgga

SEQ ID NO: 14027 - RNA, 23 nt, Artificial Sequence
  Synthetic
gaaaagagaaauaaagcggcgga

SEQ ID NO: 14028 - RNA, 24 nt, Artificial Sequence
  Synthetic
cgaaaagagaaauaaagcggcgga

SEQ ID NO: 14029 - RNA, 18 nt, Artificial Sequence
  Synthetic
uggggaagcgcgggcgga

SEQ ID NO: 14030 - RNA, 19 nt, Artificial Sequence
  Synthetic
cuggggaagcgcgggcgga

SEQ ID NO: 14031 - RNA, 20 nt, Artificial Sequence
  Synthetic
gcuggggaagcgcgggcgga

SEQ ID NO: 14032 - RNA, 21 nt, Artificial Sequence
  Synthetic
ggcuggggaagcgcgggcgga

SEQ ID NO: 14033 - RNA, 22 nt, Artificial Sequence
  Synthetic
gggcuggggaagcgcgggcgga

SEQ ID NO: 14034 - RNA, 23 nt, Artificial Sequence
  Synthetic
cgggcuggggaagcgcgggcgga

SEQ ID NO: 14035 - RNA, 24 nt, Artificial Sequence
  Synthetic
ccgggcuggggaagcgcgggcgga

SEQ ID NO: 14036 - RNA, 18 nt, Artificial Sequence
  Synthetic
ccaaggccgagccaggga

SEQ ID NO: 14037 - RNA, 19 nt, Artificial Sequence
  Synthetic
cccaaggccgagccaggga

SEQ ID NO: 14038 - RNA, 20 nt, Artificial Sequence
  Synthetic
ccccaaggccgagccaggga

SEQ ID NO: 14039 - RNA, 21 nt, Artificial Sequence
  Synthetic
cccccaaggccgagccaggga

SEQ ID NO: 14040 - RNA, 22 nt, Artificial Sequence
  Synthetic
gcccccaaggccgagccaggga

SEQ ID NO: 14041 - RNA, 23 nt, Artificial Sequence
  Synthetic
cgcccccaaggccgagccaggga

SEQ ID NO: 14042 - RNA, 24 nt, Artificial Sequence
  Synthetic
gcgcccccaaggccgagccaggga

SEQ ID NO: 14043 - RNA, 18 nt, Artificial Sequence
  Synthetic
cggccuggaaagagggga

SEQ ID NO: 14044 - RNA, 19 nt, Artificial Sequence
  Synthetic
gcggccuggaaagagggga

SEQ ID NO: 14045 - RNA, 20 nt, Artificial Sequence
  Synthetic
cgcggccuggaaagagggga

SEQ ID NO: 14046 - RNA, 21 nt, Artificial Sequence
  Synthetic
gcgcggccuggaaagagggga

SEQ ID NO: 14047 - RNA, 22 nt, Artificial Sequence
  Synthetic
cgcgcggccuggaaagagggga

SEQ ID NO: 14048 - RNA, 23 nt, Artificial Sequence
  Synthetic
ccgcgcggccuggaaagagggga

SEQ ID NO: 14049 - RNA, 24 nt, Artificial Sequence
  Synthetic
cccgcgcggccuggaaagagggga

SEQ ID NO: 14050 - RNA, 18 nt, Artificial Sequence
  Synthetic
uggcggggcgggggggga

SEQ ID NO: 14051 - RNA, 19 nt, Artificial Sequence
  Synthetic
cuggcggggcgggggggga

SEQ ID NO: 14052 - RNA, 20 nt, Artificial Sequence
  Synthetic
acuggcggggcgggggggga

SEQ ID NO: 14053 - RNA, 21 nt, Artificial Sequence
  Synthetic
aacuggcggggcgggggggga

SEQ ID NO: 14054 - RNA, 22 nt, Artificial Sequence
  Synthetic
aaacuggcggggcgggggggga

SEQ ID NO: 14055 - RNA, 23 nt, Artificial Sequence
  Synthetic
aaaacuggcggggcgggggggga

SEQ ID NO: 14056 - RNA, 24 nt, Artificial Sequence
  Synthetic
caaaacuggcggggcgggggggga

SEQ ID NO: 14057 - RNA, 18 nt, Artificial Sequence
  Synthetic
gggcgaggggagguggga

SEQ ID NO: 14058 - RNA, 19 nt, Artificial Sequence
  Synthetic
cgggcgaggggagguggga

SEQ ID NO: 14059 - RNA, 20 nt, Artificial Sequence
  Synthetic
gcgggcgaggggagguggga

SEQ ID NO: 14060 - RNA, 21 nt, Artificial Sequence
  Synthetic
agcgggcgaggggagguggga

SEQ ID NO: 14061 - RNA, 22 nt, Artificial Sequence
  Synthetic
cagcgggcgaggggagguggga

SEQ ID NO: 14062 - RNA, 23 nt, Artificial Sequence
  Synthetic
gcagcgggcgaggggagguggga

SEQ ID NO: 14063 - RNA, 24 nt, Artificial Sequence
  Synthetic
cgcagcgggcgaggggagguggga

SEQ ID NO: 14064 - RNA, 18 nt, Artificial Sequence
  Synthetic
gagcccgcgcggccugga

SEQ ID NO: 14065 - RNA, 19 nt, Artificial Sequence
  Synthetic
ggagcccgcgcggccugga

SEQ ID NO: 14066 - RNA, 20 nt, Artificial Sequence
  Synthetic
aggagcccgcgcggccugga

SEQ ID NO: 14067 - RNA, 21 nt, Artificial Sequence
  Synthetic
caggagcccgcgcggccugga

SEQ ID NO: 14068 - RNA, 22 nt, Artificial Sequence
  Synthetic
ccaggagcccgcgcggccugga

SEQ ID NO: 14069 - RNA, 23 nt, Artificial Sequence
  Synthetic
uccaggagcccgcgcggccugga

SEQ ID NO: 14070 - RNA, 24 nt, Artificial Sequence
  Synthetic
cuccaggagcccgcgcggccugga

SEQ ID NO: 14071 - RNA, 18 nt, Artificial Sequence
  Synthetic
cccauuuucuuacgguga

SEQ ID NO: 14072 - RNA, 19 nt, Artificial Sequence
  Synthetic
ccccauuuucuuacgguga

SEQ ID NO: 14073 - RNA, 20 nt, Artificial Sequence
  Synthetic
cccccauuuucuuacgguga

SEQ ID NO: 14074 - RNA, 21 nt, Artificial Sequence
  Synthetic
ccccccauuuucuuacgguga

SEQ ID NO: 14075 - RNA, 22 nt, Artificial Sequence
  Synthetic
cccccccauuuucuuacgguga

SEQ ID NO: 14076 - RNA, 23 nt, Artificial Sequence
  Synthetic
acccccccauuuucuuacgguga

SEQ ID NO: 14077 - RNA, 24 nt, Artificial Sequence
  Synthetic
uacccccccauuuucuuacgguga

SEQ ID NO: 14078 - RNA, 18 nt, Artificial Sequence
  Synthetic
gagggagcgcacggcaac

SEQ ID NO: 14079 - RNA, 19 nt, Artificial Sequence
  Synthetic
ggagggagcgcacggcaac

SEQ ID NO: 14080 - RNA, 20 nt, Artificial Sequence
  Synthetic
gggagggagcgcacggcaac

SEQ ID NO: 14081 - RNA, 21 nt, Artificial Sequence
  Synthetic
ugggagggagcgcacggcaac

SEQ ID NO: 14082 - RNA, 22 nt, Artificial Sequence
  Synthetic
gugggagggagcgcacggcaac

SEQ ID NO: 14083 - RNA, 23 nt, Artificial Sequence
  Synthetic
ggugggagggagcgcacggcaac

SEQ ID NO: 14084 - RNA, 24 nt, Artificial Sequence
  Synthetic
aggugggagggagcgcacggcaac

SEQ ID NO: 14085 - RNA, 18 nt, Artificial Sequence
  Synthetic
cugcucccccccacacac

SEQ ID NO: 14086 - RNA, 19 nt, Artificial Sequence
  Synthetic
ccugcucccccccacacac

SEQ ID NO: 14087 - RNA, 20 nt, Artificial Sequence
  Synthetic
cccugcucccccccacacac

SEQ ID NO: 14088 - RNA, 21 nt, Artificial Sequence
  Synthetic
gcccugcucccccccacacac

SEQ ID NO: 14089 - RNA, 22 nt, Artificial Sequence
  Synthetic
cgcccugcucccccccacacac

SEQ ID NO: 14090 - RNA, 23 nt, Artificial Sequence
  Synthetic
gcgcccugcucccccccacacac

SEQ ID NO: 14091 - RNA, 24 nt, Artificial Sequence
  Synthetic
ugcgcccugcucccccccacacac

SEQ ID NO: 14092 - RNA, 18 nt, Artificial Sequence
  Synthetic
aauagagcgagagugcac

SEQ ID NO: 14093 - RNA, 19 nt, Artificial Sequence
  Synthetic
aaauagagcgagagugcac

SEQ ID NO: 14094 - RNA, 20 nt, Artificial Sequence
  Synthetic
aaaauagagcgagagugcac

SEQ ID NO: 14095 - RNA, 21 nt, Artificial Sequence
  Synthetic
aaaaauagagcgagagugcac

SEQ ID NO: 14096 - RNA, 22 nt, Artificial Sequence
  Synthetic
aaaaaauagagcgagagugcac

SEQ ID NO: 14097 - RNA, 23 nt, Artificial Sequence
  Synthetic
aaaaaaauagagcgagagugcac

SEQ ID NO: 14098 - RNA, 24 nt, Artificial Sequence
  Synthetic
gaaaaaaauagagcgagagugcac

SEQ ID NO: 14099 - RNA, 18 nt, Artificial Sequence
  Synthetic
acagcaaagaaaaaucac

SEQ ID NO: 14100 - RNA, 19 nt, Artificial Sequence
  Synthetic
gacagcaaagaaaaaucac

SEQ ID NO: 14101 - RNA, 20 nt, Artificial Sequence
  Synthetic
ggacagcaaagaaaaaucac

SEQ ID NO: 14102 - RNA, 21 nt, Artificial Sequence
  Synthetic
aggacagcaaagaaaaaucac

SEQ ID NO: 14103 - RNA, 22 nt, Artificial Sequence
  Synthetic
gaggacagcaaagaaaaaucac

SEQ ID NO: 14104 - RNA, 23 nt, Artificial Sequence
  Synthetic
agaggacagcaaagaaaaaucac

SEQ ID NO: 14105 - RNA, 24 nt, Artificial Sequence
  Synthetic
gagaggacagcaaagaaaaaucac

SEQ ID NO: 14106 - RNA, 18 nt, Artificial Sequence
  Synthetic
caaggccgagccagggac

SEQ ID NO: 14107 - RNA, 19 nt, Artificial Sequence
  Synthetic
ccaaggccgagccagggac

SEQ ID NO: 14108 - RNA, 20 nt, Artificial Sequence
  Synthetic
cccaaggccgagccagggac

SEQ ID NO: 14109 - RNA, 21 nt, Artificial Sequence
  Synthetic
ccccaaggccgagccagggac

SEQ ID NO: 14110 - RNA, 22 nt, Artificial Sequence
  Synthetic
cccccaaggccgagccagggac

SEQ ID NO: 14111 - RNA, 23 nt, Artificial Sequence
  Synthetic
gcccccaaggccgagccagggac

SEQ ID NO: 14112 - RNA, 24 nt, Artificial Sequence
  Synthetic
cgcccccaaggccgagccagggac

SEQ ID NO: 14113 - RNA, 18 nt, Artificial Sequence
  Synthetic
ggccuggaaagaggggac

SEQ ID NO: 14114 - RNA, 19 nt, Artificial Sequence
  Synthetic
cggccuggaaagaggggac

SEQ ID NO: 14115 - RNA, 20 nt, Artificial Sequence
  Synthetic
gcggccuggaaagaggggac

SEQ ID NO: 14116 - RNA, 21 nt, Artificial Sequence
  Synthetic
cgcggccuggaaagaggggac

SEQ ID NO: 14117 - RNA, 22 nt, Artificial Sequence
  Synthetic
gcgcggccuggaaagaggggac

SEQ ID NO: 14118 - RNA, 23 nt, Artificial Sequence
  Synthetic
cgcgcggccuggaaagaggggac

SEQ ID NO: 14119 - RNA, 24 nt, Artificial Sequence
  Synthetic
ccgcgcggccuggaaagaggggac

SEQ ID NO: 14120 - RNA, 18 nt, Artificial Sequence
  Synthetic
auagagcgagagugcacc

SEQ ID NO: 14121 - RNA, 19 nt, Artificial Sequence
  Synthetic
aauagagcgagagugcacc

SEQ ID NO: 14122 - RNA, 20 nt, Artificial Sequence
  Synthetic
aaauagagcgagagugcacc

SEQ ID NO: 14123 - RNA, 21 nt, Artificial Sequence
  Synthetic
aaaauagagcgagagugcacc

SEQ ID NO: 14124 - RNA, 22 nt, Artificial Sequence
  Synthetic
aaaaauagagcgagagugcacc

SEQ ID NO: 14125 - RNA, 23 nt, Artificial Sequence
  Synthetic
aaaaaauagagcgagagugcacc

SEQ ID NO: 14126 - RNA, 24 nt, Artificial Sequence
  Synthetic
aaaaaaauagagcgagagugcacc

SEQ ID NO: 14127 - RNA, 18 nt, Artificial Sequence
  Synthetic
aaggccgagccagggacc

SEQ ID NO: 14128 - RNA, 19 nt, Artificial Sequence
  Synthetic
caaggccgagccagggacc

SEQ ID NO: 14129 - RNA, 20 nt, Artificial Sequence
  Synthetic
ccaaggccgagccagggacc

SEQ ID NO: 14130 - RNA, 21 nt, Artificial Sequence
  Synthetic
cccaaggccgagccagggacc

SEQ ID NO: 14131 - RNA, 22 nt, Artificial Sequence
  Synthetic
ccccaaggccgagccagggacc

SEQ ID NO: 14132 - RNA, 23 nt, Artificial Sequence
  Synthetic
cccccaaggccgagccagggacc

SEQ ID NO: 14133 - RNA, 24 nt, Artificial Sequence
  Synthetic
gcccccaaggccgagccagggacc

SEQ ID NO: 14134 - RNA, 18 nt, Artificial Sequence
  Synthetic
gccuggaaagaggggacc

SEQ ID NO: 14135 - RNA, 19 nt, Artificial Sequence
  Synthetic
ggccuggaaagaggggacc

SEQ ID NO: 14136 - RNA, 20 nt, Artificial Sequence
  Synthetic
cggccuggaaagaggggacc

SEQ ID NO: 14137 - RNA, 21 nt, Artificial Sequence
  Synthetic
gcggccuggaaagaggggacc

SEQ ID NO: 14138 - RNA, 22 nt, Artificial Sequence
  Synthetic
cgcggccuggaaagaggggacc

SEQ ID NO: 14139 - RNA, 23 nt, Artificial Sequence
  Synthetic
gcgcggccuggaaagaggggacc

SEQ ID NO: 14140 - RNA, 24 nt, Artificial Sequence
  Synthetic
cgcgcggccuggaaagaggggacc

SEQ ID NO: 14141 - RNA, 18 nt, Artificial Sequence
  Synthetic
cccgcugcacacuugacc

SEQ ID NO: 14142 - RNA, 19 nt, Artificial Sequence
  Synthetic
ucccgcugcacacuugacc

SEQ ID NO: 14143 - RNA, 20 nt, Artificial Sequence
  Synthetic
cucccgcugcacacuugacc

SEQ ID NO: 14144 - RNA, 21 nt, Artificial Sequence
  Synthetic
ccucccgcugcacacuugacc

SEQ ID NO: 14145 - RNA, 22 nt, Artificial Sequence
  Synthetic
uccucccgcugcacacuugacc

SEQ ID NO: 14146 - RNA, 23 nt, Artificial Sequence
  Synthetic
uuccucccgcugcacacuugacc

SEQ ID NO: 14147 - RNA, 24 nt, Artificial Sequence
  Synthetic
uuuccucccgcugcacacuugacc

SEQ ID NO: 14148 - RNA, 18 nt, Artificial Sequence
  Synthetic
cggcgcaggccggggccc

SEQ ID NO: 14149 - RNA, 19 nt, Artificial Sequence
  Synthetic
gcggcgcaggccggggccc

SEQ ID NO: 14150 - RNA, 20 nt, Artificial Sequence
  Synthetic
ggcggcgcaggccggggccc

SEQ ID NO: 14151 - RNA, 21 nt, Artificial Sequence
  Synthetic
aggcggcgcaggccggggccc

SEQ ID NO: 14152 - RNA, 22 nt, Artificial Sequence
  Synthetic
caggcggcgcaggccggggccc

SEQ ID NO: 14153 - RNA, 23 nt, Artificial Sequence
  Synthetic
gcaggcggcgcaggccggggccc

SEQ ID NO: 14154 - RNA, 24 nt, Artificial Sequence
  Synthetic
ggcaggcggcgcaggccggggccc

SEQ ID NO: 14155 - RNA, 18 nt, Artificial Sequence
  Synthetic
gcucgggaaacuuugccc

SEQ ID NO: 14156 - RNA, 19 nt, Artificial Sequence
  Synthetic
cgcucgggaaacuuugccc

SEQ ID NO: 14157 - RNA, 20 nt, Artificial Sequence
  Synthetic
gcgcucgggaaacuuugccc

SEQ ID NO: 14158 - RNA, 21 nt, Artificial Sequence
  Synthetic
ugcgcucgggaaacuuugccc

SEQ ID NO: 14159 - RNA, 22 nt, Artificial Sequence
  Synthetic
cugcgcucgggaaacuuugccc

SEQ ID NO: 14160 - RNA, 23 nt, Artificial Sequence
  Synthetic
gcugcgcucgggaaacuuugccc

SEQ ID NO: 14161 - RNA, 24 nt, Artificial Sequence
  Synthetic
ggcugcgcucgggaaacuuugccc

SEQ ID NO: 14162 - RNA, 18 nt, Artificial Sequence
  Synthetic
ucucaccucuuuucuccc

SEQ ID NO: 14163 - RNA, 19 nt, Artificial Sequence
  Synthetic
gucucaccucuuuucuccc

SEQ ID NO: 14164 - RNA, 20 nt, Artificial Sequence
  Synthetic
agucucaccucuuuucuccc

SEQ ID NO: 14165 - RNA, 21 nt, Artificial Sequence
  Synthetic
cagucucaccucuuuucuccc

SEQ ID NO: 14166 - RNA, 22 nt, Artificial Sequence
  Synthetic
ccagucucaccucuuuucuccc

SEQ ID NO: 14167 - RNA, 23 nt, Artificial Sequence
  Synthetic
gccagucucaccucuuuucuccc

SEQ ID NO: 14168 - RNA, 24 nt, Artificial Sequence
  Synthetic
agccagucucaccucuuuucuccc

SEQ ID NO: 14169 - RNA, 18 nt, Artificial Sequence
  Synthetic
ggggccgaaguaaaagcc

SEQ ID NO: 14170 - RNA, 19 nt, Artificial Sequence
  Synthetic
aggggccgaaguaaaagcc

SEQ ID NO: 14171 - RNA, 20 nt, Artificial Sequence
  Synthetic
caggggccgaaguaaaagcc

SEQ ID NO: 14172 - RNA, 21 nt, Artificial Sequence
  Synthetic
ccaggggccgaaguaaaagcc

SEQ ID NO: 14173 - RNA, 22 nt, Artificial Sequence
  Synthetic
gccaggggccgaaguaaaagcc

SEQ ID NO: 14174 - RNA, 23 nt, Artificial Sequence
  Synthetic
cgccaggggccgaaguaaaagcc

SEQ ID NO: 14175 - RNA, 24 nt, Artificial Sequence
  Synthetic
acgccaggggccgaaguaaaagcc

SEQ ID NO: 14176 - RNA, 18 nt, Artificial Sequence
  Synthetic
caccgggaggcugcagcc

SEQ ID NO: 14177 - RNA, 19 nt, Artificial Sequence
  Synthetic
gcaccgggaggcugcagcc

SEQ ID NO: 14178 - RNA, 20 nt, Artificial Sequence
  Synthetic
ugcaccgggaggcugcagcc

SEQ ID NO: 14179 - RNA, 21 nt, Artificial Sequence
  Synthetic
gugcaccgggaggcugcagcc

SEQ ID NO: 14180 - RNA, 22 nt, Artificial Sequence
  Synthetic
agugcaccgggaggcugcagcc

SEQ ID NO: 14181 - RNA, 23 nt, Artificial Sequence
  Synthetic
gagugcaccgggaggcugcagcc

SEQ ID NO: 14182 - RNA, 24 nt, Artificial Sequence
  Synthetic
agagugcaccgggaggcugcagcc

SEQ ID NO: 14183 - RNA, 18 nt, Artificial Sequence
  Synthetic
cgcccccaaggccgagcc

SEQ ID NO: 14184 - RNA, 19 nt, Artificial Sequence
  Synthetic
gcgcccccaaggccgagcc

SEQ ID NO: 14185 - RNA, 20 nt, Artificial Sequence
  Synthetic
ggcgcccccaaggccgagcc

SEQ ID NO: 14186 - RNA, 21 nt, Artificial Sequence
  Synthetic
gggcgcccccaaggccgagcc

SEQ ID NO: 14187 - RNA, 22 nt, Artificial Sequence
  Synthetic
agggcgcccccaaggccgagcc

SEQ ID NO: 14188 - RNA, 23 nt, Artificial Sequence
  Synthetic
gagggcgcccccaaggccgagcc

SEQ ID NO: 14189 - RNA, 24 nt, Artificial Sequence
  Synthetic
cgagggcgcccccaaggccgagcc

SEQ ID NO: 14190 - RNA, 18 nt, Artificial Sequence
  Synthetic
uccccgcguguggacgcc

SEQ ID NO: 14191 - RNA, 19 nt, Artificial Sequence
  Synthetic
cuccccgcguguggacgcc

SEQ ID NO: 14192 - RNA, 20 nt, Artificial Sequence
  Synthetic
gcuccccgcguguggacgcc

SEQ ID NO: 14193 - RNA, 21 nt, Artificial Sequence
  Synthetic
cgcuccccgcguguggacgcc

SEQ ID NO: 14194 - RNA, 22 nt, Artificial Sequence
  Synthetic
ucgcuccccgcguguggacgcc

SEQ ID NO: 14195 - RNA, 23 nt, Artificial Sequence
  Synthetic
cucgcuccccgcguguggacgcc

SEQ ID NO: 14196 - RNA, 24 nt, Artificial Sequence
  Synthetic
gcucgcuccccgcguguggacgcc

SEQ ID NO: 14197 - RNA, 18 nt, Artificial Sequence
  Synthetic
cgcggacucaggagcgcc

SEQ ID NO: 14198 - RNA, 19 nt, Artificial Sequence
  Synthetic
ccgcggacucaggagcgcc

SEQ ID NO: 14199 - RNA, 20 nt, Artificial Sequence
  Synthetic
uccgcggacucaggagcgcc

SEQ ID NO: 14200 - RNA, 21 nt, Artificial Sequence
  Synthetic
cuccgcggacucaggagcgcc

SEQ ID NO: 14201 - RNA, 22 nt, Artificial Sequence
  Synthetic
acuccgcggacucaggagcgcc

SEQ ID NO: 14202 - RNA, 23 nt, Artificial Sequence
  Synthetic
gacuccgcggacucaggagcgcc

SEQ ID NO: 14203 - RNA, 24 nt, Artificial Sequence
  Synthetic
cgacuccgcggacucaggagcgcc

SEQ ID NO: 14204 - RNA, 18 nt, Artificial Sequence
  Synthetic
ccaggagcccgcgcggcc

SEQ ID NO: 14205 - RNA, 19 nt, Artificial Sequence
  Synthetic
uccaggagcccgcgcggcc

SEQ ID NO: 14206 - RNA, 20 nt, Artificial Sequence
  Synthetic
cuccaggagcccgcgcggcc

SEQ ID NO: 14207 - RNA, 21 nt, Artificial Sequence
  Synthetic
ucuccaggagcccgcgcggcc

SEQ ID NO: 14208 - RNA, 22 nt, Artificial Sequence
  Synthetic
gucuccaggagcccgcgcggcc

SEQ ID NO: 14209 - RNA, 23 nt, Artificial Sequence
  Synthetic
agucuccaggagcccgcgcggcc

SEQ ID NO: 14210 - RNA, 24 nt, Artificial Sequence
  Synthetic
aagucuccaggagcccgcgcggcc

SEQ ID NO: 14211 - RNA, 18 nt, Artificial Sequence
  Synthetic
ggccccucucccgacucc

SEQ ID NO: 14212 - RNA, 19 nt, Artificial Sequence
  Synthetic
cggccccucucccgacucc

SEQ ID NO: 14213 - RNA, 20 nt, Artificial Sequence
  Synthetic
gcggccccucucccgacucc

SEQ ID NO: 14214 - RNA, 21 nt, Artificial Sequence
  Synthetic
cgcggccccucucccgacucc

SEQ ID NO: 14215 - RNA, 22 nt, Artificial Sequence
  Synthetic
ccgcggccccucucccgacucc

SEQ ID NO: 14216 - RNA, 23 nt, Artificial Sequence
  Synthetic
gccgcggccccucucccgacucc

SEQ ID NO: 14217 - RNA, 24 nt, Artificial Sequence
  Synthetic
cgccgcggccccucucccgacucc

SEQ ID NO: 14218 - RNA, 18 nt, Artificial Sequence
  Synthetic
ggcagcgcccaagucucc

SEQ ID NO: 14219 - RNA, 19 nt, Artificial Sequence
  Synthetic
gggcagcgcccaagucucc

SEQ ID NO: 14220 - RNA, 20 nt, Artificial Sequence
  Synthetic
agggcagcgcccaagucucc

SEQ ID NO: 14221 - RNA, 21 nt, Artificial Sequence
  Synthetic
aagggcagcgcccaagucucc

SEQ ID NO: 14222 - RNA, 22 nt, Artificial Sequence
  Synthetic
gaagggcagcgcccaagucucc

SEQ ID NO: 14223 - RNA, 23 nt, Artificial Sequence
  Synthetic
ggaagggcagcgcccaagucucc

SEQ ID NO: 14224 - RNA, 24 nt, Artificial Sequence
  Synthetic
cggaagggcagcgcccaagucucc

SEQ ID NO: 14225 - RNA, 18 nt, Artificial Sequence
  Synthetic
gucucaccucuuuucucc

SEQ ID NO: 14226 - RNA, 19 nt, Artificial Sequence
  Synthetic
agucucaccucuuuucucc

SEQ ID NO: 14227 - RNA, 20 nt, Artificial Sequence
  Synthetic
cagucucaccucuuuucucc

SEQ ID NO: 14228 - RNA, 21 nt, Artificial Sequence
  Synthetic
ccagucucaccucuuuucucc

SEQ ID NO: 14229 - RNA, 22 nt, Artificial Sequence
  Synthetic
gccagucucaccucuuuucucc

SEQ ID NO: 14230 - RNA, 23 nt, Artificial Sequence
  Synthetic
agccagucucaccucuuuucucc

SEQ ID NO: 14231 - RNA, 24 nt, Artificial Sequence
  Synthetic
aagccagucucaccucuuuucucc

SEQ ID NO: 14232 - RNA, 18 nt, Artificial Sequence
  Synthetic
cggcgcgggagggcaagc

SEQ ID NO: 14233 - RNA, 19 nt, Artificial Sequence
  Synthetic
gcggcgcgggagggcaagc

SEQ ID NO: 14234 - RNA, 20 nt, Artificial Sequence
  Synthetic
ggcggcgcgggagggcaagc

SEQ ID NO: 14235 - RNA, 18 nt, Artificial Sequence
  Synthetic
gccccgggcuggggaagc

SEQ ID NO: 14236 - RNA, 19 nt, Artificial Sequence
  Synthetic
agccccgggcuggggaagc

SEQ ID NO: 14237 - RNA, 20 nt, Artificial Sequence
  Synthetic
cagccccgggcuggggaagc

SEQ ID NO: 14238 - RNA, 21 nt, Artificial Sequence
  Synthetic
gcagccccgggcuggggaagc

SEQ ID NO: 14239 - RNA, 22 nt, Artificial Sequence
  Synthetic
ugcagccccgggcuggggaagc

SEQ ID NO: 14240 - RNA, 23 nt, Artificial Sequence
  Synthetic
cugcagccccgggcuggggaagc

SEQ ID NO: 14241 - RNA, 24 nt, Artificial Sequence
  Synthetic
gcugcagccccgggcuggggaagc

SEQ ID NO: 14242 - RNA, 18 nt, Artificial Sequence
  Synthetic
gcgcccccaaggccgagc

SEQ ID NO: 14243 - RNA, 19 nt, Artificial Sequence
  Synthetic
ggcgcccccaaggccgagc

SEQ ID NO: 14244 - RNA, 20 nt, Artificial Sequence
  Synthetic
gggcgcccccaaggccgagc

SEQ ID NO: 14245 - RNA, 21 nt, Artificial Sequence
  Synthetic
agggcgcccccaaggccgagc

SEQ ID NO: 14246 - RNA, 22 nt, Artificial Sequence
  Synthetic
gagggcgcccccaaggccgagc

SEQ ID NO: 14247 - RNA, 23 nt, Artificial Sequence
  Synthetic
cgagggcgcccccaaggccgagc

SEQ ID NO: 14248 - RNA, 24 nt, Artificial Sequence
  Synthetic
ccgagggcgcccccaaggccgagc

SEQ ID NO: 14249 - RNA, 18 nt, Artificial Sequence
  Synthetic
cuccccgcguguggacgc

SEQ ID NO: 14250 - RNA, 19 nt, Artificial Sequence
  Synthetic
gcuccccgcguguggacgc

SEQ ID NO: 14251 - RNA, 20 nt, Artificial Sequence
  Synthetic
cgcuccccgcguguggacgc

SEQ ID NO: 14252 - RNA, 21 nt, Artificial Sequence
  Synthetic
ucgcuccccgcguguggacgc

SEQ ID NO: 14253 - RNA, 22 nt, Artificial Sequence
  Synthetic
cucgcuccccgcguguggacgc

SEQ ID NO: 14254 - RNA, 23 nt, Artificial Sequence
  Synthetic
gcucgcuccccgcguguggacgc

SEQ ID NO: 14255 - RNA, 24 nt, Artificial Sequence
  Synthetic
cgcucgcuccccgcguguggacgc

SEQ ID NO: 14256 - RNA, 18 nt, Artificial Sequence
  Synthetic
gcgcgggagggcaagcgc

SEQ ID NO: 14257 - RNA, 19 nt, Artificial Sequence
  Synthetic
ggcgcgggagggcaagcgc

SEQ ID NO: 14258 - RNA, 20 nt, Artificial Sequence
  Synthetic
cggcgcgggagggcaagcgc

SEQ ID NO: 14259 - RNA, 18 nt, Artificial Sequence
  Synthetic
ccgcggacucaggagcgc

SEQ ID NO: 14260 - RNA, 19 nt, Artificial Sequence
  Synthetic
uccgcggacucaggagcgc

SEQ ID NO: 14261 - RNA, 20 nt, Artificial Sequence
  Synthetic
cuccgcggacucaggagcgc

SEQ ID NO: 14262 - RNA, 21 nt, Artificial Sequence
  Synthetic
acuccgcggacucaggagcgc

SEQ ID NO: 14263 - RNA, 22 nt, Artificial Sequence
  Synthetic
gacuccgcggacucaggagcgc

SEQ ID NO: 14264 - RNA, 23 nt, Artificial Sequence
  Synthetic
cgacuccgcggacucaggagcgc

SEQ ID NO: 14265 - RNA, 24 nt, Artificial Sequence
  Synthetic
ccgacuccgcggacucaggagcgc

SEQ ID NO: 14266 - RNA, 18 nt, Artificial Sequence
  Synthetic
ccgagcccgcggcugcgc

SEQ ID NO: 14267 - RNA, 19 nt, Artificial Sequence
  Synthetic
cccgagcccgcggcugcgc

SEQ ID NO: 14268 - RNA, 20 nt, Artificial Sequence
  Synthetic
ccccgagcccgcggcugcgc

SEQ ID NO: 14269 - RNA, 21 nt, Artificial Sequence
  Synthetic
gccccgagcccgcggcugcgc

SEQ ID NO: 14270 - RNA, 22 nt, Artificial Sequence
  Synthetic
agccccgagcccgcggcugcgc

SEQ ID NO: 14271 - RNA, 23 nt, Artificial Sequence
  Synthetic
aagccccgagcccgcggcugcgc

SEQ ID NO: 14272 - RNA, 24 nt, Artificial Sequence
  Synthetic
aaagccccgagcccgcggcugcgc

SEQ ID NO: 14273 - RNA, 18 nt, Artificial Sequence
  Synthetic
gaggcaggcggcgcaggc

SEQ ID NO: 14274 - RNA, 19 nt, Artificial Sequence
  Synthetic
agaggcaggcggcgcaggc

SEQ ID NO: 14275 - RNA, 20 nt, Artificial Sequence
  Synthetic
gagaggcaggcggcgcaggc

SEQ ID NO: 14276 - RNA, 21 nt, Artificial Sequence
  Synthetic
ggagaggcaggcggcgcaggc

SEQ ID NO: 14277 - RNA, 22 nt, Artificial Sequence
  Synthetic
gggagaggcaggcggcgcaggc

SEQ ID NO: 14278 - RNA, 23 nt, Artificial Sequence
  Synthetic
ggggagaggcaggcggcgcaggc

SEQ ID NO: 14279 - RNA, 24 nt, Artificial Sequence
  Synthetic
cggggagaggcaggcggcgcaggc

SEQ ID NO: 14280 - RNA, 18 nt, Artificial Sequence
  Synthetic
uccaggagcccgcgcggc

SEQ ID NO: 14281 - RNA, 19 nt, Artificial Sequence
  Synthetic
cuccaggagcccgcgcggc

SEQ ID NO: 14282 - RNA, 20 nt, Artificial Sequence
  Synthetic
ucuccaggagcccgcgcggc

SEQ ID NO: 14283 - RNA, 21 nt, Artificial Sequence
  Synthetic
gucuccaggagcccgcgcggc

SEQ ID NO: 14284 - RNA, 22 nt, Artificial Sequence
  Synthetic
agucuccaggagcccgcgcggc

SEQ ID NO: 14285 - RNA, 23 nt, Artificial Sequence
  Synthetic
aagucuccaggagcccgcgcggc

SEQ ID NO: 14286 - RNA, 24 nt, Artificial Sequence
  Synthetic
caagucuccaggagcccgcgcggc

SEQ ID NO: 14287 - RNA, 18 nt, Artificial Sequence
  Synthetic
gaggcugcagccccgggc

SEQ ID NO: 14288 - RNA, 19 nt, Artificial Sequence
  Synthetic
ggaggcugcagccccgggc

SEQ ID NO: 14289 - RNA, 20 nt, Artificial Sequence
  Synthetic
gggaggcugcagccccgggc

SEQ ID NO: 14290 - RNA, 21 nt, Artificial Sequence
  Synthetic
cgggaggcugcagccccgggc

SEQ ID NO: 14291 - RNA, 22 nt, Artificial Sequence
  Synthetic
ccgggaggcugcagccccgggc

SEQ ID NO: 14292 - RNA, 23 nt, Artificial Sequence
  Synthetic
accgggaggcugcagccccgggc

SEQ ID NO: 14293 - RNA, 24 nt, Artificial Sequence
  Synthetic
caccgggaggcugcagccccgggc

SEQ ID NO: 14294 - RNA, 18 nt, Artificial Sequence
  Synthetic
uacagcuccgcagcgggc

SEQ ID NO: 14295 - RNA, 19 nt, Artificial Sequence
  Synthetic
uuacagcuccgcagcgggc

SEQ ID NO: 14296 - RNA, 20 nt, Artificial Sequence
  Synthetic
guuacagcuccgcagcgggc

SEQ ID NO: 14297 - RNA, 21 nt, Artificial Sequence
  Synthetic
aguuacagcuccgcagcgggc

SEQ ID NO: 14298 - RNA, 22 nt, Artificial Sequence
  Synthetic
aaguuacagcuccgcagcgggc

SEQ ID NO: 14299 - RNA, 23 nt, Artificial Sequence
  Synthetic
caaguuacagcuccgcagcgggc

SEQ ID NO: 14300 - RNA, 24 nt, Artificial Sequence
  Synthetic
ccaaguuacagcuccgcagcgggc

SEQ ID NO: 14301 - RNA, 18 nt, Artificial Sequence
  Synthetic
ggcggcgcaggccggggc

SEQ ID NO: 14302 - RNA, 19 nt, Artificial Sequence
  Synthetic
aggcggcgcaggccggggc

SEQ ID NO: 14303 - RNA, 20 nt, Artificial Sequence
  Synthetic
caggcggcgcaggccggggc

SEQ ID NO: 14304 - RNA, 21 nt, Artificial Sequence
  Synthetic
gcaggcggcgcaggccggggc

SEQ ID NO: 14305 - RNA, 22 nt, Artificial Sequence
  Synthetic
ggcaggcggcgcaggccggggc

SEQ ID NO: 14306 - RNA, 23 nt, Artificial Sequence
  Synthetic
aggcaggcggcgcaggccggggc

SEQ ID NO: 14307 - RNA, 24 nt, Artificial Sequence
  Synthetic
gaggcaggcggcgcaggccggggc

SEQ ID NO: 14308 - RNA, 18 nt, Artificial Sequence
  Synthetic
uugcaaaacuggcggggc

SEQ ID NO: 14309 - RNA, 19 nt, Artificial Sequence
  Synthetic
uuugcaaaacuggcggggc

SEQ ID NO: 14310 - RNA, 20 nt, Artificial Sequence
  Synthetic
uuuugcaaaacuggcggggc

SEQ ID NO: 14311 - RNA, 21 nt, Artificial Sequence
  Synthetic
auuuugcaaaacuggcggggc

SEQ ID NO: 14312 - RNA, 22 nt, Artificial Sequence
  Synthetic
uauuuugcaaaacuggcggggc

SEQ ID NO: 14313 - RNA, 23 nt, Artificial Sequence
  Synthetic
uuauuuugcaaaacuggcggggc

SEQ ID NO: 14314 - RNA, 24 nt, Artificial Sequence
  Synthetic
auuauuuugcaaaacuggcggggc

SEQ ID NO: 14315 - RNA, 18 nt, Artificial Sequence
  Synthetic
caaacacccaccucuggc

SEQ ID NO: 14316 - RNA, 19 nt, Artificial Sequence
  Synthetic
acaaacacccaccucuggc

SEQ ID NO: 14317 - RNA, 20 nt, Artificial Sequence
  Synthetic
gacaaacacccaccucuggc

SEQ ID NO: 14318 - RNA, 21 nt, Artificial Sequence
  Synthetic
ggacaaacacccaccucuggc

SEQ ID NO: 14319 - RNA, 22 nt, Artificial Sequence
  Synthetic
gggacaaacacccaccucuggc

SEQ ID NO: 14320 - RNA, 23 nt, Artificial Sequence
  Synthetic
cgggacaaacacccaccucuggc

SEQ ID NO: 14321 - RNA, 24 nt, Artificial Sequence
  Synthetic
gcgggacaaacacccaccucuggc

SEQ ID NO: 14322 - RNA, 18 nt, Artificial Sequence
  Synthetic
gcgcucgggaaacuuugc

SEQ ID NO: 14323 - RNA, 19 nt, Artificial Sequence
  Synthetic
ugcgcucgggaaacuuugc

SEQ ID NO: 14324 - RNA, 20 nt, Artificial Sequence
  Synthetic
cugcgcucgggaaacuuugc

SEQ ID NO: 14325 - RNA, 21 nt, Artificial Sequence
  Synthetic
gcugcgcucgggaaacuuugc

SEQ ID NO: 14326 - RNA, 22 nt, Artificial Sequence
  Synthetic
ggcugcgcucgggaaacuuugc

SEQ ID NO: 14327 - RNA, 23 nt, Artificial Sequence
  Synthetic
cggcugcgcucgggaaacuuugc

SEQ ID NO: 14328 - RNA, 24 nt, Artificial Sequence
  Synthetic
gcggcugcgcucgggaaacuuugc

SEQ ID NO: 14329 - RNA, 18 nt, Artificial Sequence
  Synthetic
ucccgacuccgcggacuc

SEQ ID NO: 14330 - RNA, 19 nt, Artificial Sequence
  Synthetic
cucccgacuccgcggacuc

SEQ ID NO: 14331 - RNA, 20 nt, Artificial Sequence
  Synthetic
ucucccgacuccgcggacuc

SEQ ID NO: 14332 - RNA, 21 nt, Artificial Sequence
  Synthetic
cucucccgacuccgcggacuc

SEQ ID NO: 14333 - RNA, 22 nt, Artificial Sequence
  Synthetic
ccucucccgacuccgcggacuc

SEQ ID NO: 14334 - RNA, 23 nt, Artificial Sequence
  Synthetic
cccucucccgacuccgcggacuc

SEQ ID NO: 14335 - RNA, 24 nt, Artificial Sequence
  Synthetic
ccccucucccgacuccgcggacuc

SEQ ID NO: 14336 - RNA, 18 nt, Artificial Sequence
  Synthetic
gagcccgcggcugcgcuc

SEQ ID NO: 14337 - RNA, 19 nt, Artificial Sequence
  Synthetic
cgagcccgcggcugcgcuc

SEQ ID NO: 14338 - RNA, 20 nt, Artificial Sequence
  Synthetic
ccgagcccgcggcugcgcuc

SEQ ID NO: 14339 - RNA, 21 nt, Artificial Sequence
  Synthetic
cccgagcccgcggcugcgcuc

SEQ ID NO: 14340 - RNA, 22 nt, Artificial Sequence
  Synthetic
ccccgagcccgcggcugcgcuc

SEQ ID NO: 14341 - RNA, 23 nt, Artificial Sequence
  Synthetic
gccccgagcccgcggcugcgcuc

SEQ ID NO: 14342 - RNA, 24 nt, Artificial Sequence
  Synthetic
agccccgagcccgcggcugcgcuc

SEQ ID NO: 14343 - RNA, 18 nt, Artificial Sequence
  Synthetic
agccagguagaguugcuc

SEQ ID NO: 14344 - RNA, 19 nt, Artificial Sequence
  Synthetic
aagccagguagaguugcuc

SEQ ID NO: 14345 - RNA, 20 nt, Artificial Sequence
  Synthetic
gaagccagguagaguugcuc

SEQ ID NO: 14346 - RNA, 21 nt, Artificial Sequence
  Synthetic
ggaagccagguagaguugcuc

SEQ ID NO: 14347 - RNA, 22 nt, Artificial Sequence
  Synthetic
gggaagccagguagaguugcuc

SEQ ID NO: 14348 - RNA, 23 nt, Artificial Sequence
  Synthetic
agggaagccagguagaguugcuc

SEQ ID NO: 14349 - RNA, 24 nt, Artificial Sequence
  Synthetic
gagggaagccagguagaguugcuc

SEQ ID NO: 14350 - RNA, 18 nt, Artificial Sequence
  Synthetic
gggcagcgcccaagucuc

SEQ ID NO: 14351 - RNA, 19 nt, Artificial Sequence
  Synthetic
agggcagcgcccaagucuc

SEQ ID NO: 14352 - RNA, 20 nt, Artificial Sequence
  Synthetic
aagggcagcgcccaagucuc

SEQ ID NO: 14353 - RNA, 21 nt, Artificial Sequence
  Synthetic
gaagggcagcgcccaagucuc

SEQ ID NO: 14354 - RNA, 22 nt, Artificial Sequence
  Synthetic
ggaagggcagcgcccaagucuc

SEQ ID NO: 14355 - RNA, 23 nt, Artificial Sequence
  Synthetic
cggaagggcagcgcccaagucuc

SEQ ID NO: 14356 - RNA, 24 nt, Artificial Sequence
  Synthetic
ccggaagggcagcgcccaagucuc

SEQ ID NO: 14357 - RNA, 18 nt, Artificial Sequence
  Synthetic
uuuggagggcugcggguc

SEQ ID NO: 14358 - RNA, 19 nt, Artificial Sequence
  Synthetic
guuuggagggcugcggguc

SEQ ID NO: 14359 - RNA, 20 nt, Artificial Sequence
  Synthetic
aguuuggagggcugcggguc

SEQ ID NO: 14360 - RNA, 21 nt, Artificial Sequence
  Synthetic
aaguuuggagggcugcggguc

SEQ ID NO: 14361 - RNA, 22 nt, Artificial Sequence
  Synthetic
uaaguuuggagggcugcggguc

SEQ ID NO: 14362 - RNA, 23 nt, Artificial Sequence
  Synthetic
cuaaguuuggagggcugcggguc

SEQ ID NO: 14363 - RNA, 24 nt, Artificial Sequence
  Synthetic
ccuaaguuuggagggcugcggguc

SEQ ID NO: 14364 - RNA, 18 nt, Artificial Sequence
  Synthetic
cggcggaaaggaggaaag

SEQ ID NO: 14365 - RNA, 19 nt, Artificial Sequence
  Synthetic
gcggcggaaaggaggaaag

SEQ ID NO: 14366 - RNA, 20 nt, Artificial Sequence
  Synthetic
agcggcggaaaggaggaaag

SEQ ID NO: 14367 - RNA, 21 nt, Artificial Sequence
  Synthetic
aagcggcggaaaggaggaaag

SEQ ID NO: 14368 - RNA, 22 nt, Artificial Sequence
  Synthetic
aaagcggcggaaaggaggaaag

SEQ ID NO: 14369 - RNA, 23 nt, Artificial Sequence
  Synthetic
uaaagcggcggaaaggaggaaag

SEQ ID NO: 14370 - RNA, 24 nt, Artificial Sequence
  Synthetic
auaaagcggcggaaaggaggaaag

SEQ ID NO: 14371 - RNA, 18 nt, Artificial Sequence
  Synthetic
aaauaaagcggcggaaag

SEQ ID NO: 14372 - RNA, 19 nt, Artificial Sequence
  Synthetic
gaaauaaagcggcggaaag

SEQ ID NO: 14373 - RNA, 20 nt, Artificial Sequence
  Synthetic
agaaauaaagcggcggaaag

SEQ ID NO: 14374 - RNA, 21 nt, Artificial Sequence
  Synthetic
gagaaauaaagcggcggaaag

SEQ ID NO: 14375 - RNA, 22 nt, Artificial Sequence
  Synthetic
agagaaauaaagcggcggaaag

SEQ ID NO: 14376 - RNA, 23 nt, Artificial Sequence
  Synthetic
aagagaaauaaagcggcggaaag

SEQ ID NO: 14377 - RNA, 24 nt, Artificial Sequence
  Synthetic
aaagagaaauaaagcggcggaaag

SEQ ID NO: 14378 - RNA, 18 nt, Artificial Sequence
  Synthetic
cccgcgcggccuggaaag

SEQ ID NO: 14379 - RNA, 19 nt, Artificial Sequence
  Synthetic
gcccgcgcggccuggaaag

SEQ ID NO: 14380 - RNA, 20 nt, Artificial Sequence
  Synthetic
agcccgcgcggccuggaaag

SEQ ID NO: 14381 - RNA, 21 nt, Artificial Sequence
  Synthetic
gagcccgcgcggccuggaaag

SEQ ID NO: 14382 - RNA, 22 nt, Artificial Sequence
  Synthetic
ggagcccgcgcggccuggaaag

SEQ ID NO: 14383 - RNA, 23 nt, Artificial Sequence
  Synthetic
aggagcccgcgcggccuggaaag

SEQ ID NO: 14384 - RNA, 24 nt, Artificial Sequence
  Synthetic
caggagcccgcgcggccuggaaag

SEQ ID NO: 14385 - RNA, 18 nt, Artificial Sequence
  Synthetic
aagaaaaaucacccgaag

SEQ ID NO: 14386 - RNA, 19 nt, Artificial Sequence
  Synthetic
aaagaaaaaucacccgaag

SEQ ID NO: 14387 - RNA, 20 nt, Artificial Sequence
  Synthetic
caaagaaaaaucacccgaag

SEQ ID NO: 14388 - RNA, 21 nt, Artificial Sequence
  Synthetic
gcaaagaaaaaucacccgaag

SEQ ID NO: 14389 - RNA, 22 nt, Artificial Sequence
  Synthetic
agcaaagaaaaaucacccgaag

SEQ ID NO: 14390 - RNA, 23 nt, Artificial Sequence
  Synthetic
cagcaaagaaaaaucacccgaag

SEQ ID NO: 14391 - RNA, 24 nt, Artificial Sequence
  Synthetic
acagcaaagaaaaaucacccgaag

SEQ ID NO: 14392 - RNA, 18 nt, Artificial Sequence
  Synthetic
agccggcacaaaaggcag

SEQ ID NO: 14393 - RNA, 19 nt, Artificial Sequence
  Synthetic
gagccggcacaaaaggcag

SEQ ID NO: 14394 - RNA, 20 nt, Artificial Sequence
  Synthetic
ggagccggcacaaaaggcag

SEQ ID NO: 14395 - RNA, 21 nt, Artificial Sequence
  Synthetic
aggagccggcacaaaaggcag

SEQ ID NO: 14396 - RNA, 22 nt, Artificial Sequence
  Synthetic
gaggagccggcacaaaaggcag

SEQ ID NO: 14397 - RNA, 23 nt, Artificial Sequence
  Synthetic
cgaggagccggcacaaaaggcag

SEQ ID NO: 14398 - RNA, 24 nt, Artificial Sequence
  Synthetic
gcgaggagccggcacaaaaggcag

SEQ ID NO: 14399 - RNA, 18 nt, Artificial Sequence
  Synthetic
gcggaaaggaggaaagag

SEQ ID NO: 14400 - RNA, 19 nt, Artificial Sequence
  Synthetic
ggcggaaaggaggaaagag

SEQ ID NO: 14401 - RNA, 20 nt, Artificial Sequence
  Synthetic
cggcggaaaggaggaaagag

SEQ ID NO: 14402 - RNA, 21 nt, Artificial Sequence
  Synthetic
gcggcggaaaggaggaaagag

SEQ ID NO: 14403 - RNA, 22 nt, Artificial Sequence
  Synthetic
agcggcggaaaggaggaaagag

SEQ ID NO: 14404 - RNA, 23 nt, Artificial Sequence
  Synthetic
aagcggcggaaaggaggaaagag

SEQ ID NO: 14405 - RNA, 24 nt, Artificial Sequence
  Synthetic
aaagcggcggaaaggaggaaagag

SEQ ID NO: 14406 - RNA, 18 nt, Artificial Sequence
  Synthetic
aucacccgaaguugagag

SEQ ID NO: 14407 - RNA, 19 nt, Artificial Sequence
  Synthetic
aaucacccgaaguugagag

SEQ ID NO: 14408 - RNA, 20 nt, Artificial Sequence
  Synthetic
aaaucacccgaaguugagag

SEQ ID NO: 14409 - RNA, 21 nt, Artificial Sequence
  Synthetic
aaaaucacccgaaguugagag

SEQ ID NO: 14410 - RNA, 22 nt, Artificial Sequence
  Synthetic
aaaaaucacccgaaguugagag

SEQ ID NO: 14411 - RNA, 23 nt, Artificial Sequence
  Synthetic
gaaaaaucacccgaaguugagag

SEQ ID NO: 14412 - RNA, 24 nt, Artificial Sequence
  Synthetic
agaaaaaucacccgaaguugagag

SEQ ID NO: 14413 - RNA, 18 nt, Artificial Sequence
  Synthetic
cgggaaacuuugcccgag

SEQ ID NO: 14414 - RNA, 19 nt, Artificial Sequence
  Synthetic
ucgggaaacuuugcccgag

SEQ ID NO: 14415 - RNA, 20 nt, Artificial Sequence
  Synthetic
cucgggaaacuuugcccgag

SEQ ID NO: 14416 - RNA, 21 nt, Artificial Sequence
  Synthetic
gcucgggaaacuuugcccgag

SEQ ID NO: 14417 - RNA, 22 nt, Artificial Sequence
  Synthetic
cgcucgggaaacuuugcccgag

SEQ ID NO: 14418 - RNA, 23 nt, Artificial Sequence
  Synthetic
gcgcucgggaaacuuugcccgag

SEQ ID NO: 14419 - RNA, 24 nt, Artificial Sequence
  Synthetic
ugcgcucgggaaacuuugcccgag

SEQ ID NO: 14420 - RNA, 18 nt, Artificial Sequence
  Synthetic
agcuccgcagcgggcgag

SEQ ID NO: 14421 - RNA, 19 nt, Artificial Sequence
  Synthetic
cagcuccgcagcgggcgag

SEQ ID NO: 14422 - RNA, 20 nt, Artificial Sequence
  Synthetic
acagcuccgcagcgggcgag

SEQ ID NO: 14423 - RNA, 21 nt, Artificial Sequence
  Synthetic
uacagcuccgcagcgggcgag

SEQ ID NO: 14424 - RNA, 22 nt, Artificial Sequence
  Synthetic
uuacagcuccgcagcgggcgag

SEQ ID NO: 14425 - RNA, 23 nt, Artificial Sequence
  Synthetic
guuacagcuccgcagcgggcgag

SEQ ID NO: 14426 - RNA, 24 nt, Artificial Sequence
  Synthetic
aguuacagcuccgcagcgggcgag

SEQ ID NO: 14427 - RNA, 18 nt, Artificial Sequence
  Synthetic
cgcagcgggcgaggggag

SEQ ID NO: 14428 - RNA, 19 nt, Artificial Sequence
  Synthetic
ccgcagcgggcgaggggag

SEQ ID NO: 14429 - RNA, 20 nt, Artificial Sequence
  Synthetic
uccgcagcgggcgaggggag

SEQ ID NO: 14430 - RNA, 21 nt, Artificial Sequence
  Synthetic
cuccgcagcgggcgaggggag

SEQ ID NO: 14431 - RNA, 22 nt, Artificial Sequence
  Synthetic
gcuccgcagcgggcgaggggag

SEQ ID NO: 14432 - RNA, 23 nt, Artificial Sequence
  Synthetic
agcuccgcagcgggcgaggggag

SEQ ID NO: 14433 - RNA, 24 nt, Artificial Sequence
  Synthetic
cagcuccgcagcgggcgaggggag

SEQ ID NO: 14434 - RNA, 18 nt, Artificial Sequence
  Synthetic
ccauuuucuuacggugag

SEQ ID NO: 14435 - RNA, 19 nt, Artificial Sequence
  Synthetic
cccauuuucuuacggugag

SEQ ID NO: 14436 - RNA, 20 nt, Artificial Sequence
  Synthetic
ccccauuuucuuacggugag

SEQ ID NO: 14437 - RNA, 21 nt, Artificial Sequence
  Synthetic
cccccauuuucuuacggugag

SEQ ID NO: 14438 - RNA, 22 nt, Artificial Sequence
  Synthetic
ccccccauuuucuuacggugag

SEQ ID NO: 14439 - RNA, 23 nt, Artificial Sequence
  Synthetic
cccccccauuuucuuacggugag

SEQ ID NO: 14440 - RNA, 24 nt, Artificial Sequence
  Synthetic
acccccccauuuucuuacggugag

SEQ ID NO: 14441 - RNA, 18 nt, Artificial Sequence
  Synthetic
ccuggaaagaggggaccg

SEQ ID NO: 14442 - RNA, 19 nt, Artificial Sequence
  Synthetic
gccuggaaagaggggaccg

SEQ ID NO: 14443 - RNA, 20 nt, Artificial Sequence
  Synthetic
ggccuggaaagaggggaccg

SEQ ID NO: 14444 - RNA, 21 nt, Artificial Sequence
  Synthetic
cggccuggaaagaggggaccg

SEQ ID NO: 14445 - RNA, 22 nt, Artificial Sequence
  Synthetic
gcggccuggaaagaggggaccg

SEQ ID NO: 14446 - RNA, 23 nt, Artificial Sequence
  Synthetic
cgcggccuggaaagaggggaccg

SEQ ID NO: 14447 - RNA, 24 nt, Artificial Sequence
  Synthetic
gcgcggccuggaaagaggggaccg

SEQ ID NO: 14448 - RNA, 18 nt, Artificial Sequence
  Synthetic
cucgggaaacuuugcccg

SEQ ID NO: 14449 - RNA, 19 nt, Artificial Sequence
  Synthetic
gcucgggaaacuuugcccg

SEQ ID NO: 14450 - RNA, 20 nt, Artificial Sequence
  Synthetic
cgcucgggaaacuuugcccg

SEQ ID NO: 14451 - RNA, 21 nt, Artificial Sequence
  Synthetic
gcgcucgggaaacuuugcccg

SEQ ID NO: 14452 - RNA, 22 nt, Artificial Sequence
  Synthetic
ugcgcucgggaaacuuugcccg

SEQ ID NO: 14453 - RNA, 23 nt, Artificial Sequence
  Synthetic
cugcgcucgggaaacuuugcccg

SEQ ID NO: 14454 - RNA, 24 nt, Artificial Sequence
  Synthetic
gcugcgcucgggaaacuuugcccg

SEQ ID NO: 14455 - RNA, 18 nt, Artificial Sequence
  Synthetic
gaaaagagaaauaaagcg

SEQ ID NO: 14456 - RNA, 19 nt, Artificial Sequence
  Synthetic
cgaaaagagaaauaaagcg

SEQ ID NO: 14457 - RNA, 20 nt, Artificial Sequence
  Synthetic
ucgaaaagagaaauaaagcg

SEQ ID NO: 14458 - RNA, 21 nt, Artificial Sequence
  Synthetic
uucgaaaagagaaauaaagcg

SEQ ID NO: 14459 - RNA, 22 nt, Artificial Sequence
  Synthetic
uuucgaaaagagaaauaaagcg

SEQ ID NO: 14460 - RNA, 23 nt, Artificial Sequence
  Synthetic
uuuucgaaaagagaaauaaagcg

SEQ ID NO: 14461 - RNA, 24 nt, Artificial Sequence
  Synthetic
cuuuucgaaaagagaaauaaagcg

SEQ ID NO: 14462 - RNA, 18 nt, Artificial Sequence
  Synthetic
uccgcggacucaggagcg

SEQ ID NO: 14463 - RNA, 19 nt, Artificial Sequence
  Synthetic
cuccgcggacucaggagcg

SEQ ID NO: 14464 - RNA, 20 nt, Artificial Sequence
  Synthetic
acuccgcggacucaggagcg

SEQ ID NO: 14465 - RNA, 21 nt, Artificial Sequence
  Synthetic
gacuccgcggacucaggagcg

SEQ ID NO: 14466 - RNA, 22 nt, Artificial Sequence
  Synthetic
cgacuccgcggacucaggagcg

SEQ ID NO: 14467 - RNA, 23 nt, Artificial Sequence
  Synthetic
ccgacuccgcggacucaggagcg

SEQ ID NO: 14468 - RNA, 24 nt, Artificial Sequence
  Synthetic
cccgacuccgcggacucaggagcg

SEQ ID NO: 14469 - RNA, 18 nt, Artificial Sequence
  Synthetic
cgcgggagggcaagcgcg

SEQ ID NO: 14470 - RNA, 19 nt, Artificial Sequence
  Synthetic
gcgcgggagggcaagcgcg

SEQ ID NO: 14471 - RNA, 20 nt, Artificial Sequence
  Synthetic
ggcgcgggagggcaagcgcg

SEQ ID NO: 14472 - RNA, 18 nt, Artificial Sequence
  Synthetic
acagcuccgcagcgggcg

SEQ ID NO: 14473 - RNA, 19 nt, Artificial Sequence
  Synthetic
uacagcuccgcagcgggcg

SEQ ID NO: 14474 - RNA, 20 nt, Artificial Sequence
  Synthetic
uuacagcuccgcagcgggcg

SEQ ID NO: 14475 - RNA, 21 nt, Artificial Sequence
  Synthetic
guuacagcuccgcagcgggcg

SEQ ID NO: 14476 - RNA, 22 nt, Artificial Sequence
  Synthetic
aguuacagcuccgcagcgggcg

SEQ ID NO: 14477 - RNA, 23 nt, Artificial Sequence
  Synthetic
aaguuacagcuccgcagcgggcg

SEQ ID NO: 14478 - RNA, 24 nt, Artificial Sequence
  Synthetic
caaguuacagcuccgcagcgggcg

SEQ ID NO: 14479 - RNA, 18 nt, Artificial Sequence
  Synthetic
gcuggggaagcgcgggcg

SEQ ID NO: 14480 - RNA, 19 nt, Artificial Sequence
  Synthetic
ggcuggggaagcgcgggcg

SEQ ID NO: 14481 - RNA, 20 nt, Artificial Sequence
  Synthetic
gggcuggggaagcgcgggcg

SEQ ID NO: 14482 - RNA, 21 nt, Artificial Sequence
  Synthetic
cgggcuggggaagcgcgggcg

SEQ ID NO: 14483 - RNA, 22 nt, Artificial Sequence
  Synthetic
ccgggcuggggaagcgcgggcg

SEQ ID NO: 14484 - RNA, 23 nt, Artificial Sequence
  Synthetic
cccgggcuggggaagcgcgggcg

SEQ ID NO: 14485 - RNA, 24 nt, Artificial Sequence
  Synthetic
ccccgggcuggggaagcgcgggcg

SEQ ID NO: 14486 - RNA, 18 nt, Artificial Sequence
  Synthetic
ugcaaaacuggcggggcg

SEQ ID NO: 14487 - RNA, 19 nt, Artificial Sequence
  Synthetic
uugcaaaacuggcggggcg

SEQ ID NO: 14488 - RNA, 20 nt, Artificial Sequence
  Synthetic
uuugcaaaacuggcggggcg

SEQ ID NO: 14489 - RNA, 21 nt, Artificial Sequence
  Synthetic
uuuugcaaaacuggcggggcg

SEQ ID NO: 14490 - RNA, 22 nt, Artificial Sequence
  Synthetic
auuuugcaaaacuggcggggcg

SEQ ID NO: 14491 - RNA, 23 nt, Artificial Sequence
  Synthetic
uauuuugcaaaacuggcggggcg

SEQ ID NO: 14492 - RNA, 24 nt, Artificial Sequence
  Synthetic
uuauuuugcaaaacuggcggggcg

SEQ ID NO: 14493 - RNA, 18 nt, Artificial Sequence
  Synthetic
aauaaagcggcggaaagg

SEQ ID NO: 14494 - RNA, 19 nt, Artificial Sequence
  Synthetic
aaauaaagcggcggaaagg

SEQ ID NO: 14495 - RNA, 20 nt, Artificial Sequence
  Synthetic
gaaauaaagcggcggaaagg

SEQ ID NO: 14496 - RNA, 21 nt, Artificial Sequence
  Synthetic
agaaauaaagcggcggaaagg

SEQ ID NO: 14497 - RNA, 22 nt, Artificial Sequence
  Synthetic
gagaaauaaagcggcggaaagg

SEQ ID NO: 14498 - RNA, 23 nt, Artificial Sequence
  Synthetic
agagaaauaaagcggcggaaagg

SEQ ID NO: 14499 - RNA, 24 nt, Artificial Sequence
  Synthetic
aagagaaauaaagcggcggaaagg

SEQ ID NO: 14500 - RNA, 18 nt, Artificial Sequence
  Synthetic
ccgagggcgcccccaagg

SEQ ID NO: 14501 - RNA, 19 nt, Artificial Sequence
  Synthetic
cccgagggcgcccccaagg

SEQ ID NO: 14502 - RNA, 20 nt, Artificial Sequence
  Synthetic
gcccgagggcgcccccaagg

SEQ ID NO: 14503 - RNA, 21 nt, Artificial Sequence
  Synthetic
ggcccgagggcgcccccaagg

SEQ ID NO: 14504 - RNA, 22 nt, Artificial Sequence
  Synthetic
gggcccgagggcgcccccaagg

SEQ ID NO: 14505 - RNA, 23 nt, Artificial Sequence
  Synthetic
ggggcccgagggcgcccccaagg

SEQ ID NO: 14506 - RNA, 24 nt, Artificial Sequence
  Synthetic
cggggcccgagggcgcccccaagg

SEQ ID NO: 14507 - RNA, 18 nt, Artificial Sequence
  Synthetic
agaggcaggcggcgcagg

SEQ ID NO: 14508 - RNA, 19 nt, Artificial Sequence
  Synthetic
gagaggcaggcggcgcagg

SEQ ID NO: 14509 - RNA, 20 nt, Artificial Sequence
  Synthetic
ggagaggcaggcggcgcagg

SEQ ID NO: 14510 - RNA, 21 nt, Artificial Sequence
  Synthetic
gggagaggcaggcggcgcagg

SEQ ID NO: 14511 - RNA, 22 nt, Artificial Sequence
  Synthetic
ggggagaggcaggcggcgcagg

SEQ ID NO: 14512 - RNA, 23 nt, Artificial Sequence
  Synthetic
cggggagaggcaggcggcgcagg

SEQ ID NO: 14513 - RNA, 24 nt, Artificial Sequence
  Synthetic
ccggggagaggcaggcggcgcagg

SEQ ID NO: 14514 - RNA, 18 nt, Artificial Sequence
  Synthetic
gcagcgggcgaggggagg

SEQ ID NO: 14515 - RNA, 19 nt, Artificial Sequence
  Synthetic
cgcagcgggcgaggggagg

SEQ ID NO: 14516 - RNA, 20 nt, Artificial Sequence
  Synthetic
ccgcagcgggcgaggggagg

SEQ ID NO: 14517 - RNA, 21 nt, Artificial Sequence
  Synthetic
uccgcagcgggcgaggggagg

SEQ ID NO: 14518 - RNA, 22 nt, Artificial Sequence
  Synthetic
cuccgcagcgggcgaggggagg

SEQ ID NO: 14519 - RNA, 23 nt, Artificial Sequence
  Synthetic
gcuccgcagcgggcgaggggagg

SEQ ID NO: 14520 - RNA, 24 nt, Artificial Sequence
  Synthetic
agcuccgcagcgggcgaggggagg

SEQ ID NO: 14521 - RNA, 18 nt, Artificial Sequence
  Synthetic
ggagggcugcggguccgg

SEQ ID NO: 14522 - RNA, 19 nt, Artificial Sequence
  Synthetic
uggagggcugcggguccgg

SEQ ID NO: 14523 - RNA, 20 nt, Artificial Sequence
  Synthetic
uuggagggcugcggguccgg

SEQ ID NO: 14524 - RNA, 21 nt, Artificial Sequence
  Synthetic
uuuggagggcugcggguccgg

SEQ ID NO: 14525 - RNA, 22 nt, Artificial Sequence
  Synthetic
guuuggagggcugcggguccgg

SEQ ID NO: 14526 - RNA, 23 nt, Artificial Sequence
  Synthetic
aguuuggagggcugcggguccgg

SEQ ID NO: 14527 - RNA, 24 nt, Artificial Sequence
  Synthetic
aaguuuggagggcugcggguccgg

SEQ ID NO: 14528 - RNA, 18 nt, Artificial Sequence
  Synthetic
aaaagagaaauaaagcgg

SEQ ID NO: 14529 - RNA, 19 nt, Artificial Sequence
  Synthetic
gaaaagagaaauaaagcgg

SEQ ID NO: 14530 - RNA, 20 nt, Artificial Sequence
  Synthetic
cgaaaagagaaauaaagcgg

SEQ ID NO: 14531 - RNA, 21 nt, Artificial Sequence
  Synthetic
ucgaaaagagaaauaaagcgg

SEQ ID NO: 14532 - RNA, 22 nt, Artificial Sequence
  Synthetic
uucgaaaagagaaauaaagcgg

SEQ ID NO: 14533 - RNA, 23 nt, Artificial Sequence
  Synthetic
uuucgaaaagagaaauaaagcgg

SEQ ID NO: 14534 - RNA, 24 nt, Artificial Sequence
  Synthetic
uuuucgaaaagagaaauaaagcgg

SEQ ID NO: 14535 - RNA, 18 nt, Artificial Sequence
  Synthetic
guuacagcuccgcagcgg

SEQ ID NO: 14536 - RNA, 19 nt, Artificial Sequence
  Synthetic
aguuacagcuccgcagcgg

SEQ ID NO: 14537 - RNA, 20 nt, Artificial Sequence
  Synthetic
aaguuacagcuccgcagcgg

SEQ ID NO: 14538 - RNA, 21 nt, Artificial Sequence
  Synthetic
caaguuacagcuccgcagcgg

SEQ ID NO: 14539 - RNA, 22 nt, Artificial Sequence
  Synthetic
ccaaguuacagcuccgcagcgg

SEQ ID NO: 14540 - RNA, 23 nt, Artificial Sequence
  Synthetic
uccaaguuacagcuccgcagcgg

SEQ ID NO: 14541 - RNA, 24 nt, Artificial Sequence
  Synthetic
cuccaaguuacagcuccgcagcgg

SEQ ID NO: 14542 - RNA, 18 nt, Artificial Sequence
  Synthetic
cgggcuggggaagcgcgg

SEQ ID NO: 14543 - RNA, 19 nt, Artificial Sequence
  Synthetic
ccgggcuggggaagcgcgg

SEQ ID NO: 14544 - RNA, 20 nt, Artificial Sequence
  Synthetic
cccgggcuggggaagcgcgg

SEQ ID NO: 14545 - RNA, 21 nt, Artificial Sequence
  Synthetic
ccccgggcuggggaagcgcgg

SEQ ID NO: 14546 - RNA, 22 nt, Artificial Sequence
  Synthetic
gccccgggcuggggaagcgcgg

SEQ ID NO: 14547 - RNA, 23 nt, Artificial Sequence
  Synthetic
agccccgggcuggggaagcgcgg

SEQ ID NO: 14548 - RNA, 24 nt, Artificial Sequence
  Synthetic
cagccccgggcuggggaagcgcgg

SEQ ID NO: 14549 - RNA, 18 nt, Artificial Sequence
  Synthetic
cuggggaagcgcgggcgg

SEQ ID NO: 14550 - RNA, 19 nt, Artificial Sequence
  Synthetic
gcuggggaagcgcgggcgg

SEQ ID NO: 14551 - RNA, 20 nt, Artificial Sequence
  Synthetic
ggcuggggaagcgcgggcgg

SEQ ID NO: 14552 - RNA, 21 nt, Artificial Sequence
  Synthetic
gggcuggggaagcgcgggcgg

SEQ ID NO: 14553 - RNA, 22 nt, Artificial Sequence
  Synthetic
cgggcuggggaagcgcgggcgg

SEQ ID NO: 14554 - RNA, 23 nt, Artificial Sequence
  Synthetic
ccgggcuggggaagcgcgggcgg

SEQ ID NO: 14555 - RNA, 24 nt, Artificial Sequence
  Synthetic
cccgggcuggggaagcgcgggcgg

SEQ ID NO: 14556 - RNA, 18 nt, Artificial Sequence
  Synthetic
gcaaaacuggcggggcgg

SEQ ID NO: 14557 - RNA, 19 nt, Artificial Sequence
  Synthetic
ugcaaaacuggcggggcgg

SEQ ID NO: 14558 - RNA, 20 nt, Artificial Sequence
  Synthetic
uugcaaaacuggcggggcgg

SEQ ID NO: 14559 - RNA, 21 nt, Artificial Sequence
  Synthetic
uuugcaaaacuggcggggcgg

SEQ ID NO: 14560 - RNA, 22 nt, Artificial Sequence
  Synthetic
uuuugcaaaacuggcggggcgg

SEQ ID NO: 14561 - RNA, 23 nt, Artificial Sequence
  Synthetic
auuuugcaaaacuggcggggcgg

SEQ ID NO: 14562 - RNA, 24 nt, Artificial Sequence
  Synthetic
uauuuugcaaaacuggcggggcgg

SEQ ID NO: 14563 - RNA, 18 nt, Artificial Sequence
  Synthetic
uggaaagaggggaccggg

SEQ ID NO: 14564 - RNA, 19 nt, Artificial Sequence
  Synthetic
cuggaaagaggggaccggg

SEQ ID NO: 14565 - RNA, 20 nt, Artificial Sequence
  Synthetic
ccuggaaagaggggaccggg

SEQ ID NO: 14566 - RNA, 21 nt, Artificial Sequence
  Synthetic
gccuggaaagaggggaccggg

SEQ ID NO: 14567 - RNA, 22 nt, Artificial Sequence
  Synthetic
ggccuggaaagaggggaccggg

SEQ ID NO: 14568 - RNA, 23 nt, Artificial Sequence
  Synthetic
cggccuggaaagaggggaccggg

SEQ ID NO: 14569 - RNA, 24 nt, Artificial Sequence
  Synthetic
gcggccuggaaagaggggaccggg

SEQ ID NO: 14570 - RNA, 18 nt, Artificial Sequence
  Synthetic
ggaggcugcagccccggg

SEQ ID NO: 14571 - RNA, 19 nt, Artificial Sequence
  Synthetic
gggaggcugcagccccggg

SEQ ID NO: 14572 - RNA, 20 nt, Artificial Sequence
  Synthetic
cgggaggcugcagccccggg

SEQ ID NO: 14573 - RNA, 21 nt, Artificial Sequence
  Synthetic
ccgggaggcugcagccccggg

SEQ ID NO: 14574 - RNA, 22 nt, Artificial Sequence
  Synthetic
accgggaggcugcagccccggg

SEQ ID NO: 14575 - RNA, 23 nt, Artificial Sequence
  Synthetic
caccgggaggcugcagccccggg

SEQ ID NO: 14576 - RNA, 24 nt, Artificial Sequence
  Synthetic
gcaccgggaggcugcagccccggg

SEQ ID NO: 14577 - RNA, 18 nt, Artificial Sequence
  Synthetic
gggcuggggaagcgcggg

SEQ ID NO: 14578 - RNA, 19 nt, Artificial Sequence
  Synthetic
cgggcuggggaagcgcggg

SEQ ID NO: 14579 - RNA, 20 nt, Artificial Sequence
  Synthetic
ccgggcuggggaagcgcggg

SEQ ID NO: 14580 - RNA, 21 nt, Artificial Sequence
  Synthetic
cccgggcuggggaagcgcggg

SEQ ID NO: 14581 - RNA, 22 nt, Artificial Sequence
  Synthetic
ccccgggcuggggaagcgcggg

SEQ ID NO: 14582 - RNA, 23 nt, Artificial Sequence
  Synthetic
gccccgggcuggggaagcgcggg

SEQ ID NO: 14583 - RNA, 24 nt, Artificial Sequence
  Synthetic
agccccgggcuggggaagcgcggg

SEQ ID NO: 14584 - RNA, 18 nt, Artificial Sequence
  Synthetic
caaaacuggcggggcggg

SEQ ID NO: 14585 - RNA, 19 nt, Artificial Sequence
  Synthetic
gcaaaacuggcggggcggg

SEQ ID NO: 14586 - RNA, 20 nt, Artificial Sequence
  Synthetic
ugcaaaacuggcggggcggg

SEQ ID NO: 14587 - RNA, 21 nt, Artificial Sequence
  Synthetic
uugcaaaacuggcggggcggg

SEQ ID NO: 14588 - RNA, 22 nt, Artificial Sequence
  Synthetic
uuugcaaaacuggcggggcggg

SEQ ID NO: 14589 - RNA, 23 nt, Artificial Sequence
  Synthetic
uuuugcaaaacuggcggggcggg

SEQ ID NO: 14590 - RNA, 24 nt, Artificial Sequence
  Synthetic
auuuugcaaaacuggcggggcggg

SEQ ID NO: 14591 - RNA, 18 nt, Artificial Sequence
  Synthetic
uuuugcaaaacuggcggg

SEQ ID NO: 14592 - RNA, 19 nt, Artificial Sequence
  Synthetic
auuuugcaaaacuggcggg

SEQ ID NO: 14593 - RNA, 20 nt, Artificial Sequence
  Synthetic
uauuuugcaaaacuggcggg

SEQ ID NO: 14594 - RNA, 21 nt, Artificial Sequence
  Synthetic
uuauuuugcaaaacuggcggg

SEQ ID NO: 14595 - RNA, 22 nt, Artificial Sequence
  Synthetic
auuauuuugcaaaacuggcggg

SEQ ID NO: 14596 - RNA, 23 nt, Artificial Sequence
  Synthetic
cauuauuuugcaaaacuggcggg

SEQ ID NO: 14597 - RNA, 24 nt, Artificial Sequence
  Synthetic
ucauuauuuugcaaaacuggcggg

SEQ ID NO: 14598 - RNA, 18 nt, Artificial Sequence
  Synthetic
gcguguggacgccagggg

SEQ ID NO: 14599 - RNA, 19 nt, Artificial Sequence
  Synthetic
cgcguguggacgccagggg

SEQ ID NO: 14600 - RNA, 20 nt, Artificial Sequence
  Synthetic
ccgcguguggacgccagggg

SEQ ID NO: 14601 - RNA, 21 nt, Artificial Sequence
  Synthetic
cccgcguguggacgccagggg

SEQ ID NO: 14602 - RNA, 22 nt, Artificial Sequence
  Synthetic
ccccgcguguggacgccagggg

SEQ ID NO: 14603 - RNA, 23 nt, Artificial Sequence
  Synthetic
uccccgcguguggacgccagggg

SEQ ID NO: 14604 - RNA, 24 nt, Artificial Sequence
  Synthetic
cuccccgcguguggacgccagggg

SEQ ID NO: 14605 - RNA, 18 nt, Artificial Sequence
  Synthetic
aaaacuggcggggcgggg

SEQ ID NO: 14606 - RNA, 19 nt, Artificial Sequence
  Synthetic
caaaacuggcggggcgggg

SEQ ID NO: 14607 - RNA, 20 nt, Artificial Sequence
  Synthetic
gcaaaacuggcggggcgggg

SEQ ID NO: 14608 - RNA, 21 nt, Artificial Sequence
  Synthetic
ugcaaaacuggcggggcgggg

SEQ ID NO: 14609 - RNA, 22 nt, Artificial Sequence
  Synthetic
uugcaaaacuggcggggcgggg

SEQ ID NO: 14610 - RNA, 23 nt, Artificial Sequence
  Synthetic
uuugcaaaacuggcggggcgggg

SEQ ID NO: 14611 - RNA, 24 nt, Artificial Sequence
  Synthetic
uuuugcaaaacuggcggggcgggg

SEQ ID NO: 14612 - RNA, 18 nt, Artificial Sequence
  Synthetic
uuugcaaaacuggcgggg

SEQ ID NO: 14613 - RNA, 19 nt, Artificial Sequence
  Synthetic
uuuugcaaaacuggcgggg

SEQ ID NO: 14614 - RNA, 20 nt, Artificial Sequence
  Synthetic
auuuugcaaaacuggcgggg

SEQ ID NO: 14615 - RNA, 21 nt, Artificial Sequence
  Synthetic
uauuuugcaaaacuggcgggg

SEQ ID NO: 14616 - RNA, 22 nt, Artificial Sequence
  Synthetic
uuauuuugcaaaacuggcgggg

SEQ ID NO: 14617 - RNA, 23 nt, Artificial Sequence
  Synthetic
auuauuuugcaaaacuggcgggg

SEQ ID NO: 14618 - RNA, 24 nt, Artificial Sequence
  Synthetic
cauuauuuugcaaaacuggcgggg

SEQ ID NO: 14619 - RNA, 18 nt, Artificial Sequence
  Synthetic
cgggcgaggggagguggg

SEQ ID NO: 14620 - RNA, 19 nt, Artificial Sequence
  Synthetic
gcgggcgaggggagguggg

SEQ ID NO: 14621 - RNA, 20 nt, Artificial Sequence
  Synthetic
agcgggcgaggggagguggg

SEQ ID NO: 14622 - RNA, 21 nt, Artificial Sequence
  Synthetic
cagcgggcgaggggagguggg

SEQ ID NO: 14623 - RNA, 22 nt, Artificial Sequence
  Synthetic
gcagcgggcgaggggagguggg

SEQ ID NO: 14624 - RNA, 23 nt, Artificial Sequence
  Synthetic
cgcagcgggcgaggggagguggg

SEQ ID NO: 14625 - RNA, 24 nt, Artificial Sequence
  Synthetic
ccgcagcgggcgaggggagguggg

SEQ ID NO: 14626 - RNA, 18 nt, Artificial Sequence
  Synthetic
auuauuuugcaaaacugg

SEQ ID NO: 14627 - RNA, 19 nt, Artificial Sequence
  Synthetic
cauuauuuugcaaaacugg

SEQ ID NO: 14628 - RNA, 20 nt, Artificial Sequence
  Synthetic
ucauuauuuugcaaaacugg

SEQ ID NO: 14629 - RNA, 21 nt, Artificial Sequence
  Synthetic
uucauuauuuugcaaaacugg

SEQ ID NO: 14630 - RNA, 22 nt, Artificial Sequence
  Synthetic
guucauuauuuugcaaaacugg

SEQ ID NO: 14631 - RNA, 23 nt, Artificial Sequence
  Synthetic
uguucauuauuuugcaaaacugg

SEQ ID NO: 14632 - RNA, 24 nt, Artificial Sequence
  Synthetic
uuguucauuauuuugcaaaacugg

SEQ ID NO: 14633 - RNA, 18 nt, Artificial Sequence
  Synthetic
acaaacacccaccucugg

SEQ ID NO: 14634 - RNA, 19 nt, Artificial Sequence
  Synthetic
gacaaacacccaccucugg

SEQ ID NO: 14635 - RNA, 20 nt, Artificial Sequence
  Synthetic
ggacaaacacccaccucugg

SEQ ID NO: 14636 - RNA, 21 nt, Artificial Sequence
  Synthetic
gggacaaacacccaccucugg

SEQ ID NO: 14637 - RNA, 22 nt, Artificial Sequence
  Synthetic
cgggacaaacacccaccucugg

SEQ ID NO: 14638 - RNA, 23 nt, Artificial Sequence
  Synthetic
gcgggacaaacacccaccucugg

SEQ ID NO: 14639 - RNA, 24 nt, Artificial Sequence
  Synthetic
agcgggacaaacacccaccucugg

SEQ ID NO: 14640 - RNA, 18 nt, Artificial Sequence
  Synthetic
gcgggcgaggggaggugg

SEQ ID NO: 14641 - RNA, 19 nt, Artificial Sequence
  Synthetic
agcgggcgaggggaggugg

SEQ ID NO: 14642 - RNA, 20 nt, Artificial Sequence
  Synthetic
cagcgggcgaggggaggugg

SEQ ID NO: 14643 - RNA, 21 nt, Artificial Sequence
  Synthetic
gcagcgggcgaggggaggugg

SEQ ID NO: 14644 - RNA, 22 nt, Artificial Sequence
  Synthetic
cgcagcgggcgaggggaggugg

SEQ ID NO: 14645 - RNA, 23 nt, Artificial Sequence
  Synthetic
ccgcagcgggcgaggggaggugg

SEQ ID NO: 14646 - RNA, 24 nt, Artificial Sequence
  Synthetic
uccgcagcgggcgaggggaggugg

SEQ ID NO: 14647 - RNA, 18 nt, Artificial Sequence
  Synthetic
cauuauuuugcaaaacug

SEQ ID NO: 14648 - RNA, 19 nt, Artificial Sequence
  Synthetic
ucauuauuuugcaaaacug

SEQ ID NO: 14649 - RNA, 20 nt, Artificial Sequence
  Synthetic
uucauuauuuugcaaaacug

SEQ ID NO: 14650 - RNA, 21 nt, Artificial Sequence
  Synthetic
guucauuauuuugcaaaacug

SEQ ID NO: 14651 - RNA, 22 nt, Artificial Sequence
  Synthetic
uguucauuauuuugcaaaacug

SEQ ID NO: 14652 - RNA, 23 nt, Artificial Sequence
  Synthetic
uuguucauuauuuugcaaaacug

SEQ ID NO: 14653 - RNA, 24 nt, Artificial Sequence
  Synthetic
auuguucauuauuuugcaaaacug

SEQ ID NO: 14654 - RNA, 18 nt, Artificial Sequence
  Synthetic
ggcugcagccccgggcug

SEQ ID NO: 14655 - RNA, 19 nt, Artificial Sequence
  Synthetic
aggcugcagccccgggcug

SEQ ID NO: 14656 - RNA, 20 nt, Artificial Sequence
  Synthetic
gaggcugcagccccgggcug

SEQ ID NO: 14657 - RNA, 21 nt, Artificial Sequence
  Synthetic
ggaggcugcagccccgggcug

SEQ ID NO: 14658 - RNA, 22 nt, Artificial Sequence
  Synthetic
gggaggcugcagccccgggcug

SEQ ID NO: 14659 - RNA, 23 nt, Artificial Sequence
  Synthetic
cgggaggcugcagccccgggcug

SEQ ID NO: 14660 - RNA, 24 nt, Artificial Sequence
  Synthetic
ccgggaggcugcagccccgggcug

SEQ ID NO: 14661 - RNA, 18 nt, Artificial Sequence
  Synthetic
gccacuuucucacuauug

SEQ ID NO: 14662 - RNA, 19 nt, Artificial Sequence
  Synthetic
ugccacuuucucacuauug

SEQ ID NO: 14663 - RNA, 20 nt, Artificial Sequence
  Synthetic
gugccacuuucucacuauug

SEQ ID NO: 14664 - RNA, 21 nt, Artificial Sequence
  Synthetic
agugccacuuucucacuauug

SEQ ID NO: 14665 - RNA, 22 nt, Artificial Sequence
  Synthetic
cagugccacuuucucacuauug

SEQ ID NO: 14666 - RNA, 23 nt, Artificial Sequence
  Synthetic
acagugccacuuucucacuauug

SEQ ID NO: 14667 - RNA, 24 nt, Artificial Sequence
  Synthetic
cacagugccacuuucucacuauug

SEQ ID NO: 14668 - RNA, 18 nt, Artificial Sequence
  Synthetic
gaauccagccuaaguuug

SEQ ID NO: 14669 - RNA, 19 nt, Artificial Sequence
  Synthetic
ggaauccagccuaaguuug

SEQ ID NO: 14670 - RNA, 20 nt, Artificial Sequence
  Synthetic
cggaauccagccuaaguuug

SEQ ID NO: 14671 - RNA, 21 nt, Artificial Sequence
  Synthetic
gcggaauccagccuaaguuug

SEQ ID NO: 14672 - RNA, 22 nt, Artificial Sequence
  Synthetic
cgcggaauccagccuaaguuug

SEQ ID NO: 14673 - RNA, 23 nt, Artificial Sequence
  Synthetic
acgcggaauccagccuaaguuug

SEQ ID NO: 14674 - RNA, 24 nt, Artificial Sequence
  Synthetic
aacgcggaauccagccuaaguuug

SEQ ID NO: 14675 - RNA, 18 nt, Artificial Sequence
  Synthetic
cucccgacuccgcggacu

SEQ ID NO: 14676 - RNA, 19 nt, Artificial Sequence
  Synthetic
ucucccgacuccgcggacu

SEQ ID NO: 14677 - RNA, 20 nt, Artificial Sequence
  Synthetic
cucucccgacuccgcggacu

SEQ ID NO: 14678 - RNA, 21 nt, Artificial Sequence
  Synthetic
ccucucccgacuccgcggacu

SEQ ID NO: 14679 - RNA, 22 nt, Artificial Sequence
  Synthetic
cccucucccgacuccgcggacu

SEQ ID NO: 14680 - RNA, 23 nt, Artificial Sequence
  Synthetic
ccccucucccgacuccgcggacu

SEQ ID NO: 14681 - RNA, 24 nt, Artificial Sequence
  Synthetic
gccccucucccgacuccgcggacu

SEQ ID NO: 14682 - RNA, 18 nt, Artificial Sequence
  Synthetic
cgagcccgcggcugcgcu

SEQ ID NO: 14683 - RNA, 19 nt, Artificial Sequence
  Synthetic
ccgagcccgcggcugcgcu

SEQ ID NO: 14684 - RNA, 20 nt, Artificial Sequence
  Synthetic
cccgagcccgcggcugcgcu

SEQ ID NO: 14685 - RNA, 21 nt, Artificial Sequence
  Synthetic
ccccgagcccgcggcugcgcu

SEQ ID NO: 14686 - RNA, 22 nt, Artificial Sequence
  Synthetic
gccccgagcccgcggcugcgcu

SEQ ID NO: 14687 - RNA, 23 nt, Artificial Sequence
  Synthetic
agccccgagcccgcggcugcgcu

SEQ ID NO: 14688 - RNA, 24 nt, Artificial Sequence
  Synthetic
aagccccgagcccgcggcugcgcu

SEQ ID NO: 14689 - RNA, 18 nt, Artificial Sequence
  Synthetic
aggcugcagccccgggcu

SEQ ID NO: 14690 - RNA, 19 nt, Artificial Sequence
  Synthetic
gaggcugcagccccgggcu

SEQ ID NO: 14691 - RNA, 20 nt, Artificial Sequence
  Synthetic
ggaggcugcagccccgggcu

SEQ ID NO: 14692 - RNA, 21 nt, Artificial Sequence
  Synthetic
gggaggcugcagccccgggcu

SEQ ID NO: 14693 - RNA, 22 nt, Artificial Sequence
  Synthetic
cgggaggcugcagccccgggcu

SEQ ID NO: 14694 - RNA, 23 nt, Artificial Sequence
  Synthetic
ccgggaggcugcagccccgggcu

SEQ ID NO: 14695 - RNA, 24 nt, Artificial Sequence
  Synthetic
accgggaggcugcagccccgggcu

SEQ ID NO: 14696 - RNA, 18 nt, Artificial Sequence
  Synthetic
gcggaauccagccuaagu

SEQ ID NO: 14697 - RNA, 19 nt, Artificial Sequence
  Synthetic
cgcggaauccagccuaagu

SEQ ID NO: 14698 - RNA, 20 nt, Artificial Sequence
  Synthetic
acgcggaauccagccuaagu

SEQ ID NO: 14699 - RNA, 21 nt, Artificial Sequence
  Synthetic
aacgcggaauccagccuaagu

SEQ ID NO: 14700 - RNA, 22 nt, Artificial Sequence
  Synthetic
caacgcggaauccagccuaagu

SEQ ID NO: 14701 - RNA, 23 nt, Artificial Sequence
  Synthetic
gcaacgcggaauccagccuaagu

SEQ ID NO: 14702 - RNA, 24 nt, Artificial Sequence
  Synthetic
ggcaacgcggaauccagccuaagu

SEQ ID NO: 14703 - RNA, 18 nt, Artificial Sequence
  Synthetic
cauuuucuuacggugagu

SEQ ID NO: 14704 - RNA, 19 nt, Artificial Sequence
  Synthetic
ccauuuucuuacggugagu

SEQ ID NO: 14705 - RNA, 20 nt, Artificial Sequence
  Synthetic
cccauuuucuuacggugagu

SEQ ID NO: 14706 - RNA, 21 nt, Artificial Sequence
  Synthetic
ccccauuuucuuacggugagu

SEQ ID NO: 14707 - RNA, 22 nt, Artificial Sequence
  Synthetic
cccccauuuucuuacggugagu

SEQ ID NO: 14708 - RNA, 23 nt, Artificial Sequence
  Synthetic
ccccccauuuucuuacggugagu

SEQ ID NO: 14709 - RNA, 24 nt, Artificial Sequence
  Synthetic
cccccccauuuucuuacggugagu

SEQ ID NO: 14710 - RNA, 18 nt, Artificial Sequence
  Synthetic
cgcgcucgcuccccgcgu

SEQ ID NO: 14711 - RNA, 19 nt, Artificial Sequence
  Synthetic
ccgcgcucgcuccccgcgu

SEQ ID NO: 14712 - RNA, 20 nt, Artificial Sequence
  Synthetic
gccgcgcucgcuccccgcgu

SEQ ID NO: 14713 - RNA, 21 nt, Artificial Sequence
  Synthetic
cgccgcgcucgcuccccgcgu

SEQ ID NO: 14714 - RNA, 22 nt, Artificial Sequence
  Synthetic
ccgccgcgcucgcuccccgcgu

SEQ ID NO: 14715 - RNA, 23 nt, Artificial Sequence
  Synthetic
gccgccgcgcucgcuccccgcgu

SEQ ID NO: 14716 - RNA, 24 nt, Artificial Sequence
  Synthetic
cgccgccgcgcucgcuccccgcgu

SEQ ID NO: 14717 - RNA, 18 nt, Artificial Sequence
  Synthetic
cagcgggcgaggggaggu

SEQ ID NO: 14718 - RNA, 19 nt, Artificial Sequence
  Synthetic
gcagcgggcgaggggaggu

SEQ ID NO: 14719 - RNA, 20 nt, Artificial Sequence
  Synthetic
cgcagcgggcgaggggaggu

SEQ ID NO: 14720 - RNA, 21 nt, Artificial Sequence
  Synthetic
ccgcagcgggcgaggggaggu

SEQ ID NO: 14721 - RNA, 22 nt, Artificial Sequence
  Synthetic
uccgcagcgggcgaggggaggu

SEQ ID NO: 14722 - RNA, 23 nt, Artificial Sequence
  Synthetic
cuccgcagcgggcgaggggaggu

SEQ ID NO: 14723 - RNA, 24 nt, Artificial Sequence
  Synthetic
gcuccgcagcgggcgaggggaggu

SEQ ID NO: 14724 - RNA, 18 nt, Artificial Sequence
  Synthetic
guuuggagggcugcgggu

SEQ ID NO: 14725 - RNA, 19 nt, Artificial Sequence
  Synthetic
aguuuggagggcugcgggu

SEQ ID NO: 14726 - RNA, 20 nt, Artificial Sequence
  Synthetic
aaguuuggagggcugcgggu

SEQ ID NO: 14727 - RNA, 21 nt, Artificial Sequence
  Synthetic
uaaguuuggagggcugcgggu

SEQ ID NO: 14728 - RNA, 22 nt, Artificial Sequence
  Synthetic
cuaaguuuggagggcugcgggu

SEQ ID NO: 14729 - RNA, 23 nt, Artificial Sequence
  Synthetic
ccuaaguuuggagggcugcgggu

SEQ ID NO: 14730 - RNA, 24 nt, Artificial Sequence
  Synthetic
gccuaaguuuggagggcugcgggu

SEQ ID NO: 14731 - RNA, 18 nt, Artificial Sequence
  Synthetic
ugccacuuucucacuauu

SEQ ID NO: 14732 - RNA, 19 nt, Artificial Sequence
  Synthetic
gugccacuuucucacuauu

SEQ ID NO: 14733 - RNA, 20 nt, Artificial Sequence
  Synthetic
agugccacuuucucacuauu

SEQ ID NO: 14734 - RNA, 21 nt, Artificial Sequence
  Synthetic
cagugccacuuucucacuauu

SEQ ID NO: 14735 - RNA, 22 nt, Artificial Sequence
  Synthetic
acagugccacuuucucacuauu

SEQ ID NO: 14736 - RNA, 23 nt, Artificial Sequence
  Synthetic
cacagugccacuuucucacuauu

SEQ ID NO: 14737 - RNA, 24 nt, Artificial Sequence
  Synthetic
ccacagugccacuuucucacuauu

SEQ ID NO: 14738 - RNA, 18 nt, Artificial Sequence
  Synthetic
gaaaaaucacccgaaguu

SEQ ID NO: 14739 - RNA, 19 nt, Artificial Sequence
  Synthetic
agaaaaaucacccgaaguu

SEQ ID NO: 14740 - RNA, 20 nt, Artificial Sequence
  Synthetic
aagaaaaaucacccgaaguu

SEQ ID NO: 14741 - RNA, 21 nt, Artificial Sequence
  Synthetic
aaagaaaaaucacccgaaguu

SEQ ID NO: 14742 - RNA, 22 nt, Artificial Sequence
  Synthetic
caaagaaaaaucacccgaaguu

SEQ ID NO: 14743 - RNA, 23 nt, Artificial Sequence
  Synthetic
gcaaagaaaaaucacccgaaguu

SEQ ID NO: 14744 - RNA, 24 nt, Artificial Sequence
  Synthetic
agcaaagaaaaaucacccgaaguu

SEQ ID NO: 14745 - RNA, 18 nt, Artificial Sequence
  Synthetic
cggaauccagccuaaguu

SEQ ID NO: 14746 - RNA, 19 nt, Artificial Sequence
  Synthetic
gcggaauccagccuaaguu

SEQ ID NO: 14747 - RNA, 20 nt, Artificial Sequence
  Synthetic
cgcggaauccagccuaaguu

SEQ ID NO: 14748 - RNA, 21 nt, Artificial Sequence
  Synthetic
acgcggaauccagccuaaguu

SEQ ID NO: 14749 - RNA, 22 nt, Artificial Sequence
  Synthetic
aacgcggaauccagccuaaguu

SEQ ID NO: 14750 - RNA, 23 nt, Artificial Sequence
  Synthetic
caacgcggaauccagccuaaguu

SEQ ID NO: 14751 - RNA, 24 nt, Artificial Sequence
  Synthetic
gcaacgcggaauccagccuaaguu

SEQ ID NO: 14752 - RNA, 18 nt, Artificial Sequence
  Synthetic
gaaucauugcauuccuuu

SEQ ID NO: 14753 - RNA, 19 nt, Artificial Sequence
  Synthetic
ggaaucauugcauuccuuu

SEQ ID NO: 14754 - RNA, 20 nt, Artificial Sequence
  Synthetic
uggaaucauugcauuccuuu

SEQ ID NO: 14755 - RNA, 21 nt, Artificial Sequence
  Synthetic
guggaaucauugcauuccuuu

SEQ ID NO: 14756 - RNA, 22 nt, Artificial Sequence
  Synthetic
aguggaaucauugcauuccuuu

SEQ ID NO: 14757 - RNA, 23 nt, Artificial Sequence
  Synthetic
gaguggaaucauugcauuccuuu

SEQ ID NO: 14758 - RNA, 24 nt, Artificial Sequence
  Synthetic
ggaguggaaucauugcauuccuuu

SEQ ID NO: 14759 - RNA, 18 nt, Artificial Sequence
  Synthetic
ccacucaccguaagaaaa

SEQ ID NO: 14760 - RNA, 19 nt, Artificial Sequence
  Synthetic
cccacucaccguaagaaaa

SEQ ID NO: 14761 - RNA, 20 nt, Artificial Sequence
  Synthetic
ucccacucaccguaagaaaa

SEQ ID NO: 14762 - RNA, 21 nt, Artificial Sequence
  Synthetic
uucccacucaccguaagaaaa

SEQ ID NO: 14763 - RNA, 22 nt, Artificial Sequence
  Synthetic
cuucccacucaccguaagaaaa

SEQ ID NO: 14764 - RNA, 23 nt, Artificial Sequence
  Synthetic
gcuucccacucaccguaagaaaa

SEQ ID NO: 14765 - RNA, 24 nt, Artificial Sequence
  Synthetic
ugcuucccacucaccguaagaaaa

SEQ ID NO: 14766 - RNA, 18 nt, Artificial Sequence
  Synthetic
cccacucaccguaagaaa

SEQ ID NO: 14767 - RNA, 19 nt, Artificial Sequence
  Synthetic
ucccacucaccguaagaaa

SEQ ID NO: 14768 - RNA, 20 nt, Artificial Sequence
  Synthetic
uucccacucaccguaagaaa

SEQ ID NO: 14769 - RNA, 21 nt, Artificial Sequence
  Synthetic
cuucccacucaccguaagaaa

SEQ ID NO: 14770 - RNA, 22 nt, Artificial Sequence
  Synthetic
gcuucccacucaccguaagaaa

SEQ ID NO: 14771 - RNA, 23 nt, Artificial Sequence
  Synthetic
ugcuucccacucaccguaagaaa

SEQ ID NO: 14772 - RNA, 24 nt, Artificial Sequence
  Synthetic
uugcuucccacucaccguaagaaa

SEQ ID NO: 14773 - RNA, 18 nt, Artificial Sequence
  Synthetic
ugggagcugguggggaaa

SEQ ID NO: 14774 - RNA, 19 nt, Artificial Sequence
  Synthetic
gugggagcugguggggaaa

SEQ ID NO: 14775 - RNA, 20 nt, Artificial Sequence
  Synthetic
ggugggagcugguggggaaa

SEQ ID NO: 14776 - RNA, 21 nt, Artificial Sequence
  Synthetic
gggugggagcugguggggaaa

SEQ ID NO: 14777 - RNA, 22 nt, Artificial Sequence
  Synthetic
ggggugggagcugguggggaaa

SEQ ID NO: 14778 - RNA, 23 nt, Artificial Sequence
  Synthetic
gggggugggagcugguggggaaa

SEQ ID NO: 14779 - RNA, 24 nt, Artificial Sequence
  Synthetic
ugggggugggagcugguggggaaa

SEQ ID NO: 14780 - RNA, 18 nt, Artificial Sequence
  Synthetic
aacgauucccggggagaa

SEQ ID NO: 14781 - RNA, 19 nt, Artificial Sequence
  Synthetic
aaacgauucccggggagaa

SEQ ID NO: 14782 - RNA, 20 nt, Artificial Sequence
  Synthetic
aaaacgauucccggggagaa

SEQ ID NO: 14783 - RNA, 21 nt, Artificial Sequence
  Synthetic
aaaaacgauucccggggagaa

SEQ ID NO: 14784 - RNA, 22 nt, Artificial Sequence
  Synthetic
aaaaaacgauucccggggagaa

SEQ ID NO: 14785 - RNA, 23 nt, Artificial Sequence
  Synthetic
uaaaaaacgauucccggggagaa

SEQ ID NO: 14786 - RNA, 24 nt, Artificial Sequence
  Synthetic
cuaaaaaacgauucccggggagaa

SEQ ID NO: 14787 - RNA, 18 nt, Artificial Sequence
  Synthetic
uuuauuucucuuuucgaa

SEQ ID NO: 14788 - RNA, 19 nt, Artificial Sequence
  Synthetic
cuuuauuucucuuuucgaa

SEQ ID NO: 14789 - RNA, 20 nt, Artificial Sequence
  Synthetic
gcuuuauuucucuuuucgaa

SEQ ID NO: 14790 - RNA, 21 nt, Artificial Sequence
  Synthetic
cgcuuuauuucucuuuucgaa

SEQ ID NO: 14791 - RNA, 22 nt, Artificial Sequence
  Synthetic
ccgcuuuauuucucuuuucgaa

SEQ ID NO: 14792 - RNA, 23 nt, Artificial Sequence
  Synthetic
gccgcuuuauuucucuuuucgaa

SEQ ID NO: 14793 - RNA, 24 nt, Artificial Sequence
  Synthetic
cgccgcuuuauuucucuuuucgaa

SEQ ID NO: 14794 - RNA, 18 nt, Artificial Sequence
  Synthetic
gugggagcugguggggaa

SEQ ID NO: 14795 - RNA, 19 nt, Artificial Sequence
  Synthetic
ggugggagcugguggggaa

SEQ ID NO: 14796 - RNA, 20 nt, Artificial Sequence
  Synthetic
gggugggagcugguggggaa

SEQ ID NO: 14797 - RNA, 21 nt, Artificial Sequence
  Synthetic
ggggugggagcugguggggaa

SEQ ID NO: 14798 - RNA, 22 nt, Artificial Sequence
  Synthetic
gggggugggagcugguggggaa

SEQ ID NO: 14799 - RNA, 23 nt, Artificial Sequence
  Synthetic
ugggggugggagcugguggggaa

SEQ ID NO: 14800 - RNA, 24 nt, Artificial Sequence
  Synthetic
cugggggugggagcugguggggaa

SEQ ID NO: 14801 - RNA, 18 nt, Artificial Sequence
  Synthetic
gaaaguggcacuguggaa

SEQ ID NO: 14802 - RNA, 19 nt, Artificial Sequence
  Synthetic
agaaaguggcacuguggaa

SEQ ID NO: 14803 - RNA, 20 nt, Artificial Sequence
  Synthetic
gagaaaguggcacuguggaa

SEQ ID NO: 14804 - RNA, 21 nt, Artificial Sequence
  Synthetic
ugagaaaguggcacuguggaa

SEQ ID NO: 14805 - RNA, 22 nt, Artificial Sequence
  Synthetic
gugagaaaguggcacuguggaa

SEQ ID NO: 14806 - RNA, 23 nt, Artificial Sequence
  Synthetic
agugagaaaguggcacuguggaa

SEQ ID NO: 14807 - RNA, 24 nt, Artificial Sequence
  Synthetic
uagugagaaaguggcacuguggaa

SEQ ID NO: 14808 - RNA, 18 nt, Artificial Sequence
  Synthetic
cucacggucaagugugca

SEQ ID NO: 14809 - RNA, 19 nt, Artificial Sequence
  Synthetic
gcucacggucaagugugca

SEQ ID NO: 14810 - RNA, 20 nt, Artificial Sequence
  Synthetic
cgcucacggucaagugugca

SEQ ID NO: 14811 - RNA, 21 nt, Artificial Sequence
  Synthetic
gcgcucacggucaagugugca

SEQ ID NO: 14812 - RNA, 22 nt, Artificial Sequence
  Synthetic
cgcgcucacggucaagugugca

SEQ ID NO: 14813 - RNA, 23 nt, Artificial Sequence
  Synthetic
gcgcgcucacggucaagugugca

SEQ ID NO: 14814 - RNA, 24 nt, Artificial Sequence
  Synthetic
agcgcgcucacggucaagugugca

SEQ ID NO: 14815 - RNA, 18 nt, Artificial Sequence
  Synthetic
ggagaggggccgcggcga

SEQ ID NO: 14816 - RNA, 19 nt, Artificial Sequence
  Synthetic
gggagaggggccgcggcga

SEQ ID NO: 14817 - RNA, 20 nt, Artificial Sequence
  Synthetic
cgggagaggggccgcggcga

SEQ ID NO: 14818 - RNA, 21 nt, Artificial Sequence
  Synthetic
ucgggagaggggccgcggcga

SEQ ID NO: 14819 - RNA, 22 nt, Artificial Sequence
  Synthetic
gucgggagaggggccgcggcga

SEQ ID NO: 14820 - RNA, 23 nt, Artificial Sequence
  Synthetic
agucgggagaggggccgcggcga

SEQ ID NO: 14821 - RNA, 24 nt, Artificial Sequence
  Synthetic
gagucgggagaggggccgcggcga

SEQ ID NO: 14822 - RNA, 18 nt, Artificial Sequence
  Synthetic
ccgugggaccgggaagga

SEQ ID NO: 14823 - RNA, 19 nt, Artificial Sequence
  Synthetic
gccgugggaccgggaagga

SEQ ID NO: 14824 - RNA, 20 nt, Artificial Sequence
  Synthetic
agccgugggaccgggaagga

SEQ ID NO: 14825 - RNA, 21 nt, Artificial Sequence
  Synthetic
gagccgugggaccgggaagga

SEQ ID NO: 14826 - RNA, 22 nt, Artificial Sequence
  Synthetic
agagccgugggaccgggaagga

SEQ ID NO: 14827 - RNA, 23 nt, Artificial Sequence
  Synthetic
gagagccgugggaccgggaagga

SEQ ID NO: 14828 - RNA, 24 nt, Artificial Sequence
  Synthetic
ggagagccgugggaccgggaagga

SEQ ID NO: 14829 - RNA, 18 nt, Artificial Sequence
  Synthetic
gaguccgcggagucggga

SEQ ID NO: 14830 - RNA, 19 nt, Artificial Sequence
  Synthetic
ugaguccgcggagucggga

SEQ ID NO: 14831 - RNA, 20 nt, Artificial Sequence
  Synthetic
cugaguccgcggagucggga

SEQ ID NO: 14832 - RNA, 21 nt, Artificial Sequence
  Synthetic
ccugaguccgcggagucggga

SEQ ID NO: 14833 - RNA, 22 nt, Artificial Sequence
  Synthetic
uccugaguccgcggagucggga

SEQ ID NO: 14834 - RNA, 23 nt, Artificial Sequence
  Synthetic
cuccugaguccgcggagucggga

SEQ ID NO: 14835 - RNA, 24 nt, Artificial Sequence
  Synthetic
gcuccugaguccgcggagucggga

SEQ ID NO: 14836 - RNA, 18 nt, Artificial Sequence
  Synthetic
ggcguccacacgcgggga

SEQ ID NO: 14837 - RNA, 19 nt, Artificial Sequence
  Synthetic
uggcguccacacgcgggga

SEQ ID NO: 14838 - RNA, 20 nt, Artificial Sequence
  Synthetic
cuggcguccacacgcgggga

SEQ ID NO: 14839 - RNA, 21 nt, Artificial Sequence
  Synthetic
ccuggcguccacacgcgggga

SEQ ID NO: 14840 - RNA, 22 nt, Artificial Sequence
  Synthetic
cccuggcguccacacgcgggga

SEQ ID NO: 14841 - RNA, 23 nt, Artificial Sequence
  Synthetic
ccccuggcguccacacgcgggga

SEQ ID NO: 14842 - RNA, 24 nt, Artificial Sequence
  Synthetic
gccccuggcguccacacgcgggga

SEQ ID NO: 14843 - RNA, 18 nt, Artificial Sequence
  Synthetic
gcgcggcggcggcgggga

SEQ ID NO: 14844 - RNA, 19 nt, Artificial Sequence
  Synthetic
agcgcggcggcggcgggga

SEQ ID NO: 14845 - RNA, 20 nt, Artificial Sequence
  Synthetic
gagcgcggcggcggcgggga

SEQ ID NO: 14846 - RNA, 21 nt, Artificial Sequence
  Synthetic
cgagcgcggcggcggcgggga

SEQ ID NO: 14847 - RNA, 22 nt, Artificial Sequence
  Synthetic
gcgagcgcggcggcggcgggga

SEQ ID NO: 14848 - RNA, 23 nt, Artificial Sequence
  Synthetic
agcgagcgcggcggcggcgggga

SEQ ID NO: 14849 - RNA, 24 nt, Artificial Sequence
  Synthetic
gagcgagcgcggcggcggcgggga

SEQ ID NO: 14850 - RNA, 18 nt, Artificial Sequence
  Synthetic
ggugggagcuggugggga

SEQ ID NO: 14851 - RNA, 19 nt, Artificial Sequence
  Synthetic
gggugggagcuggugggga

SEQ ID NO: 14852 - RNA, 20 nt, Artificial Sequence
  Synthetic
ggggugggagcuggugggga

SEQ ID NO: 14853 - RNA, 21 nt, Artificial Sequence
  Synthetic
gggggugggagcuggugggga

SEQ ID NO: 14854 - RNA, 22 nt, Artificial Sequence
  Synthetic
ugggggugggagcuggugggga

SEQ ID NO: 14855 - RNA, 23 nt, Artificial Sequence
  Synthetic
cugggggugggagcuggugggga

SEQ ID NO: 14856 - RNA, 24 nt, Artificial Sequence
  Synthetic
ccugggggugggagcuggugggga

SEQ ID NO: 14857 - RNA, 18 nt, Artificial Sequence
  Synthetic
acggggagagccguggga

SEQ ID NO: 14858 - RNA, 19 nt, Artificial Sequence
  Synthetic
gacggggagagccguggga

SEQ ID NO: 14859 - RNA, 20 nt, Artificial Sequence
  Synthetic
cgacggggagagccguggga

SEQ ID NO: 14860 - RNA, 21 nt, Artificial Sequence
  Synthetic
gcgacggggagagccguggga

SEQ ID NO: 14861 - RNA, 22 nt, Artificial Sequence
  Synthetic
ggcgacggggagagccguggga

SEQ ID NO: 14862 - RNA, 23 nt, Artificial Sequence
  Synthetic
cggcgacggggagagccguggga

SEQ ID NO: 14863 - RNA, 24 nt, Artificial Sequence
  Synthetic
gcggcgacggggagagccguggga

SEQ ID NO: 14864 - RNA, 18 nt, Artificial Sequence
  Synthetic
agaaaguggcacugugga

SEQ ID NO: 14865 - RNA, 19 nt, Artificial Sequence
  Synthetic
gagaaaguggcacugugga

SEQ ID NO: 14866 - RNA, 20 nt, Artificial Sequence
  Synthetic
ugagaaaguggcacugugga

SEQ ID NO: 14867 - RNA, 21 nt, Artificial Sequence
  Synthetic
gugagaaaguggcacugugga

SEQ ID NO: 14868 - RNA, 22 nt, Artificial Sequence
  Synthetic
agugagaaaguggcacugugga

SEQ ID NO: 14869 - RNA, 23 nt, Artificial Sequence
  Synthetic
uagugagaaaguggcacugugga

SEQ ID NO: 14870 - RNA, 24 nt, Artificial Sequence
  Synthetic
auagugagaaaguggcacugugga

SEQ ID NO: 14871 - RNA, 18 nt, Artificial Sequence
  Synthetic
cgccaguuuugcaaaaua

SEQ ID NO: 14872 - RNA, 19 nt, Artificial Sequence
  Synthetic
ccgccaguuuugcaaaaua

SEQ ID NO: 14873 - RNA, 20 nt, Artificial Sequence
  Synthetic
cccgccaguuuugcaaaaua

SEQ ID NO: 14874 - RNA, 21 nt, Artificial Sequence
  Synthetic
ccccgccaguuuugcaaaaua

SEQ ID NO: 14875 - RNA, 22 nt, Artificial Sequence
  Synthetic
gccccgccaguuuugcaaaaua

SEQ ID NO: 14876 - RNA, 23 nt, Artificial Sequence
  Synthetic
cgccccgccaguuuugcaaaaua

SEQ ID NO: 14877 - RNA, 24 nt, Artificial Sequence
  Synthetic
ccgccccgccaguuuugcaaaaua

SEQ ID NO: 14878 - RNA, 18 nt, Artificial Sequence
  Synthetic
guagucauccccacaaua

SEQ ID NO: 14879 - RNA, 19 nt, Artificial Sequence
  Synthetic
aguagucauccccacaaua

SEQ ID NO: 14880 - RNA, 20 nt, Artificial Sequence
  Synthetic
aaguagucauccccacaaua

SEQ ID NO: 14881 - RNA, 21 nt, Artificial Sequence
  Synthetic
aaaguagucauccccacaaua

SEQ ID NO: 14882 - RNA, 22 nt, Artificial Sequence
  Synthetic
gaaaguagucauccccacaaua

SEQ ID NO: 14883 - RNA, 23 nt, Artificial Sequence
  Synthetic
ggaaaguagucauccccacaaua

SEQ ID NO: 14884 - RNA, 24 nt, Artificial Sequence
  Synthetic
aggaaaguagucauccccacaaua

SEQ ID NO: 14885 - RNA, 18 nt, Artificial Sequence
  Synthetic
gggaagugggugugcgua

SEQ ID NO: 14886 - RNA, 19 nt, Artificial Sequence
  Synthetic
ggggaagugggugugcgua

SEQ ID NO: 14887 - RNA, 20 nt, Artificial Sequence
  Synthetic
aggggaagugggugugcgua

SEQ ID NO: 14888 - RNA, 21 nt, Artificial Sequence
  Synthetic
gaggggaagugggugugcgua

SEQ ID NO: 14889 - RNA, 22 nt, Artificial Sequence
  Synthetic
ggaggggaagugggugugcgua

SEQ ID NO: 14890 - RNA, 23 nt, Artificial Sequence
  Synthetic
gggaggggaagugggugugcgua

SEQ ID NO: 14891 - RNA, 24 nt, Artificial Sequence
  Synthetic
ggggaggggaagugggugugcgua

SEQ ID NO: 14892 - RNA, 18 nt, Artificial Sequence
  Synthetic
uaagaaaaugggggggua

SEQ ID NO: 14893 - RNA, 19 nt, Artificial Sequence
  Synthetic
guaagaaaaugggggggua

SEQ ID NO: 14894 - RNA, 20 nt, Artificial Sequence
  Synthetic
cguaagaaaaugggggggua

SEQ ID NO: 14895 - RNA, 21 nt, Artificial Sequence
  Synthetic
ccguaagaaaaugggggggua

SEQ ID NO: 14896 - RNA, 22 nt, Artificial Sequence
  Synthetic
accguaagaaaaugggggggua

SEQ ID NO: 14897 - RNA, 23 nt, Artificial Sequence
  Synthetic
caccguaagaaaaugggggggua

SEQ ID NO: 14898 - RNA, 24 nt, Artificial Sequence
  Synthetic
ucaccguaagaaaaugggggggua

SEQ ID NO: 14899 - RNA, 18 nt, Artificial Sequence
  Synthetic
aacaacucacaugcaaac

SEQ ID NO: 14900 - RNA, 19 nt, Artificial Sequence
  Synthetic
gaacaacucacaugcaaac

SEQ ID NO: 14901 - RNA, 20 nt, Artificial Sequence
  Synthetic
cgaacaacucacaugcaaac

SEQ ID NO: 14902 - RNA, 21 nt, Artificial Sequence
  Synthetic
gcgaacaacucacaugcaaac

SEQ ID NO: 14903 - RNA, 22 nt, Artificial Sequence
  Synthetic
ugcgaacaacucacaugcaaac

SEQ ID NO: 14904 - RNA, 23 nt, Artificial Sequence
  Synthetic
uugcgaacaacucacaugcaaac

SEQ ID NO: 14905 - RNA, 24 nt, Artificial Sequence
  Synthetic
guugcgaacaacucacaugcaaac

SEQ ID NO: 14906 - RNA, 18 nt, Artificial Sequence
  Synthetic
ccgcugcggagcuguaac

SEQ ID NO: 14907 - RNA, 19 nt, Artificial Sequence
  Synthetic
cccgcugcggagcuguaac

SEQ ID NO: 14908 - RNA, 20 nt, Artificial Sequence
  Synthetic
gcccgcugcggagcuguaac

SEQ ID NO: 14909 - RNA, 21 nt, Artificial Sequence
  Synthetic
cgcccgcugcggagcuguaac

SEQ ID NO: 14910 - RNA, 22 nt, Artificial Sequence
  Synthetic
ucgcccgcugcggagcuguaac

SEQ ID NO: 14911 - RNA, 23 nt, Artificial Sequence
  Synthetic
cucgcccgcugcggagcuguaac

SEQ ID NO: 14912 - RNA, 24 nt, Artificial Sequence
  Synthetic
ccucgcccgcugcggagcuguaac

SEQ ID NO: 14913 - RNA, 18 nt, Artificial Sequence
  Synthetic
ggccccuggcguccacac

SEQ ID NO: 14914 - RNA, 19 nt, Artificial Sequence
  Synthetic
cggccccuggcguccacac

SEQ ID NO: 14915 - RNA, 20 nt, Artificial Sequence
  Synthetic
ucggccccuggcguccacac

SEQ ID NO: 14916 - RNA, 21 nt, Artificial Sequence
  Synthetic
uucggccccuggcguccacac

SEQ ID NO: 14917 - RNA, 22 nt, Artificial Sequence
  Synthetic
cuucggccccuggcguccacac

SEQ ID NO: 14918 - RNA, 23 nt, Artificial Sequence
  Synthetic
acuucggccccuggcguccacac

SEQ ID NO: 14919 - RNA, 24 nt, Artificial Sequence
  Synthetic
uacuucggccccuggcguccacac

SEQ ID NO: 14920 - RNA, 18 nt, Artificial Sequence
  Synthetic
gcgcgggcuccuggagac

SEQ ID NO: 14921 - RNA, 19 nt, Artificial Sequence
  Synthetic
cgcgcgggcuccuggagac

SEQ ID NO: 14922 - RNA, 20 nt, Artificial Sequence
  Synthetic
ccgcgcgggcuccuggagac

SEQ ID NO: 14923 - RNA, 21 nt, Artificial Sequence
  Synthetic
gccgcgcgggcuccuggagac

SEQ ID NO: 14924 - RNA, 22 nt, Artificial Sequence
  Synthetic
ggccgcgcgggcuccuggagac

SEQ ID NO: 14925 - RNA, 23 nt, Artificial Sequence
  Synthetic
aggccgcgcgggcuccuggagac

SEQ ID NO: 14926 - RNA, 24 nt, Artificial Sequence
  Synthetic
caggccgcgcgggcuccuggagac

SEQ ID NO: 14927 - RNA, 18 nt, Artificial Sequence
  Synthetic
gagaggggccgcggcgac

SEQ ID NO: 14928 - RNA, 19 nt, Artificial Sequence
  Synthetic
ggagaggggccgcggcgac

SEQ ID NO: 14929 - RNA, 20 nt, Artificial Sequence
  Synthetic
gggagaggggccgcggcgac

SEQ ID NO: 14930 - RNA, 21 nt, Artificial Sequence
  Synthetic
cgggagaggggccgcggcgac

SEQ ID NO: 14931 - RNA, 22 nt, Artificial Sequence
  Synthetic
ucgggagaggggccgcggcgac

SEQ ID NO: 14932 - RNA, 23 nt, Artificial Sequence
  Synthetic
gucgggagaggggccgcggcgac

SEQ ID NO: 14933 - RNA, 24 nt, Artificial Sequence
  Synthetic
agucgggagaggggccgcggcgac

SEQ ID NO: 14934 - RNA, 18 nt, Artificial Sequence
  Synthetic
cgugggaccgggaaggac

SEQ ID NO: 14935 - RNA, 19 nt, Artificial Sequence
  Synthetic
ccgugggaccgggaaggac

SEQ ID NO: 14936 - RNA, 20 nt, Artificial Sequence
  Synthetic
gccgugggaccgggaaggac

SEQ ID NO: 14937 - RNA, 21 nt, Artificial Sequence
  Synthetic
agccgugggaccgggaaggac

SEQ ID NO: 14938 - RNA, 22 nt, Artificial Sequence
  Synthetic
gagccgugggaccgggaaggac

SEQ ID NO: 14939 - RNA, 23 nt, Artificial Sequence
  Synthetic
agagccgugggaccgggaaggac

SEQ ID NO: 14940 - RNA, 24 nt, Artificial Sequence
  Synthetic
gagagccgugggaccgggaaggac

SEQ ID NO: 14941 - RNA, 18 nt, Artificial Sequence
  Synthetic
cggggagagccgugggac

SEQ ID NO: 14942 - RNA, 19 nt, Artificial Sequence
  Synthetic
acggggagagccgugggac

SEQ ID NO: 14943 - RNA, 20 nt, Artificial Sequence
  Synthetic
gacggggagagccgugggac

SEQ ID NO: 14944 - RNA, 21 nt, Artificial Sequence
  Synthetic
cgacggggagagccgugggac

SEQ ID NO: 14945 - RNA, 22 nt, Artificial Sequence
  Synthetic
gcgacggggagagccgugggac

SEQ ID NO: 14946 - RNA, 23 nt, Artificial Sequence
  Synthetic
ggcgacggggagagccgugggac

SEQ ID NO: 14947 - RNA, 24 nt, Artificial Sequence
  Synthetic
cggcgacggggagagccgugggac

SEQ ID NO: 14948 - RNA, 18 nt, Artificial Sequence
  Synthetic
acaacucacaugcaaacc

SEQ ID NO: 14949 - RNA, 19 nt, Artificial Sequence
  Synthetic
aacaacucacaugcaaacc

SEQ ID NO: 14950 - RNA, 20 nt, Artificial Sequence
  Synthetic
gaacaacucacaugcaaacc

SEQ ID NO: 14951 - RNA, 21 nt, Artificial Sequence
  Synthetic
cgaacaacucacaugcaaacc

SEQ ID NO: 14952 - RNA, 22 nt, Artificial Sequence
  Synthetic
gcgaacaacucacaugcaaacc

SEQ ID NO: 14953 - RNA, 23 nt, Artificial Sequence
  Synthetic
ugcgaacaacucacaugcaaacc

SEQ ID NO: 14954 - RNA, 24 nt, Artificial Sequence
  Synthetic
uugcgaacaacucacaugcaaacc

SEQ ID NO: 14955 - RNA, 18 nt, Artificial Sequence
  Synthetic
ggggagagccgugggacc

SEQ ID NO: 14956 - RNA, 19 nt, Artificial Sequence
  Synthetic
cggggagagccgugggacc

SEQ ID NO: 14957 - RNA, 20 nt, Artificial Sequence
  Synthetic
acggggagagccgugggacc

SEQ ID NO: 14958 - RNA, 21 nt, Artificial Sequence
  Synthetic
gacggggagagccgugggacc

SEQ ID NO: 14959 - RNA, 22 nt, Artificial Sequence
  Synthetic
cgacggggagagccgugggacc

SEQ ID NO: 14960 - RNA, 23 nt, Artificial Sequence
  Synthetic
gcgacggggagagccgugggacc

SEQ ID NO: 14961 - RNA, 24 nt, Artificial Sequence
  Synthetic
ggcgacggggagagccgugggacc

SEQ ID NO: 14962 - RNA, 18 nt, Artificial Sequence
  Synthetic
ucggccuugggggcgccc

SEQ ID NO: 14963 - RNA, 19 nt, Artificial Sequence
  Synthetic
cucggccuugggggcgccc

SEQ ID NO: 14964 - RNA, 20 nt, Artificial Sequence
  Synthetic
gcucggccuugggggcgccc

SEQ ID NO: 14965 - RNA, 21 nt, Artificial Sequence
  Synthetic
ggcucggccuugggggcgccc

SEQ ID NO: 14966 - RNA, 22 nt, Artificial Sequence
  Synthetic
uggcucggccuugggggcgccc

SEQ ID NO: 14967 - RNA, 23 nt, Artificial Sequence
  Synthetic
cuggcucggccuugggggcgccc

SEQ ID NO: 14968 - RNA, 24 nt, Artificial Sequence
  Synthetic
ccuggcucggccuugggggcgccc

SEQ ID NO: 14969 - RNA, 18 nt, Artificial Sequence
  Synthetic
gucuaaaaaacgauuccc

SEQ ID NO: 14970 - RNA, 19 nt, Artificial Sequence
  Synthetic
agucuaaaaaacgauuccc

SEQ ID NO: 14971 - RNA, 20 nt, Artificial Sequence
  Synthetic
aagucuaaaaaacgauuccc

SEQ ID NO: 14972 - RNA, 21 nt, Artificial Sequence
  Synthetic
caagucuaaaaaacgauuccc

SEQ ID NO: 14973 - RNA, 22 nt, Artificial Sequence
  Synthetic
acaagucuaaaaaacgauuccc

SEQ ID NO: 14974 - RNA, 23 nt, Artificial Sequence
  Synthetic
uacaagucuaaaaaacgauuccc

SEQ ID NO: 14975 - RNA, 24 nt, Artificial Sequence
  Synthetic
guacaagucuaaaaaacgauuccc

SEQ ID NO: 14976 - RNA, 18 nt, Artificial Sequence
  Synthetic
gcccgcgcuuccccagcc

SEQ ID NO: 14977 - RNA, 19 nt, Artificial Sequence
  Synthetic
cgcccgcgcuuccccagcc

SEQ ID NO: 14978 - RNA, 20 nt, Artificial Sequence
  Synthetic
ccgcccgcgcuuccccagcc

SEQ ID NO: 14979 - RNA, 21 nt, Artificial Sequence
  Synthetic
uccgcccgcgcuuccccagcc

SEQ ID NO: 14980 - RNA, 22 nt, Artificial Sequence
  Synthetic
cuccgcccgcgcuuccccagcc

SEQ ID NO: 14981 - RNA, 23 nt, Artificial Sequence
  Synthetic
ccuccgcccgcgcuuccccagcc

SEQ ID NO: 14982 - RNA, 24 nt, Artificial Sequence
  Synthetic
cccuccgcccgcgcuuccccagcc

SEQ ID NO: 14983 - RNA, 18 nt, Artificial Sequence
  Synthetic
aguuucccgagcgcagcc

SEQ ID NO: 14984 - RNA, 19 nt, Artificial Sequence
  Synthetic
aaguuucccgagcgcagcc

SEQ ID NO: 14985 - RNA, 20 nt, Artificial Sequence
  Synthetic
aaaguuucccgagcgcagcc

SEQ ID NO: 14986 - RNA, 21 nt, Artificial Sequence
  Synthetic
caaaguuucccgagcgcagcc

SEQ ID NO: 14987 - RNA, 22 nt, Artificial Sequence
  Synthetic
gcaaaguuucccgagcgcagcc

SEQ ID NO: 14988 - RNA, 23 nt, Artificial Sequence
  Synthetic
ggcaaaguuucccgagcgcagcc

SEQ ID NO: 14989 - RNA, 24 nt, Artificial Sequence
  Synthetic
gggcaaaguuucccgagcgcagcc

SEQ ID NO: 14990 - RNA, 18 nt, Artificial Sequence
  Synthetic
gcggcgacggggagagcc

SEQ ID NO: 14991 - RNA, 19 nt, Artificial Sequence
  Synthetic
cgcggcgacggggagagcc

SEQ ID NO: 14992 - RNA, 20 nt, Artificial Sequence
  Synthetic
ccgcggcgacggggagagcc

SEQ ID NO: 14993 - RNA, 21 nt, Artificial Sequence
  Synthetic
gccgcggcgacggggagagcc

SEQ ID NO: 14994 - RNA, 22 nt, Artificial Sequence
  Synthetic
ggccgcggcgacggggagagcc

SEQ ID NO: 14995 - RNA, 23 nt, Artificial Sequence
  Synthetic
gggccgcggcgacggggagagcc

SEQ ID NO: 14996 - RNA, 24 nt, Artificial Sequence
  Synthetic
ggggccgcggcgacggggagagcc

SEQ ID NO: 14997 - RNA, 18 nt, Artificial Sequence
  Synthetic
ccggucccuggcucggcc

SEQ ID NO: 14998 - RNA, 19 nt, Artificial Sequence
  Synthetic
cccggucccuggcucggcc

SEQ ID NO: 14999 - RNA, 20 nt, Artificial Sequence
  Synthetic
ucccggucccuggcucggcc

SEQ ID NO: 15000 - RNA, 18 nt, Artificial Sequence
  Synthetic
ccaggccgcgcgggcucc

SEQ ID NO: 15001 - RNA, 19 nt, Artificial Sequence
  Synthetic
uccaggccgcgcgggcucc

SEQ ID NO: 15002 - RNA, 20 nt, Artificial Sequence
  Synthetic
uuccaggccgcgcgggcucc

SEQ ID NO: 15003 - RNA, 21 nt, Artificial Sequence
  Synthetic
uuuccaggccgcgcgggcucc

SEQ ID NO: 15004 - RNA, 22 nt, Artificial Sequence
  Synthetic
cuuuccaggccgcgcgggcucc

SEQ ID NO: 15005 - RNA, 23 nt, Artificial Sequence
  Synthetic
ucuuuccaggccgcgcgggcucc

SEQ ID NO: 15006 - RNA, 24 nt, Artificial Sequence
  Synthetic
cucuuuccaggccgcgcgggcucc

SEQ ID NO: 15007 - RNA, 18 nt, Artificial Sequence
  Synthetic
uucuuugcuguccucucc

SEQ ID NO: 15008 - RNA, 19 nt, Artificial Sequence
  Synthetic
uuucuuugcuguccucucc

SEQ ID NO: 15009 - RNA, 20 nt, Artificial Sequence
  Synthetic
uuuucuuugcuguccucucc

SEQ ID NO: 15010 - RNA, 21 nt, Artificial Sequence
  Synthetic
uuuuucuuugcuguccucucc

SEQ ID NO: 15011 - RNA, 22 nt, Artificial Sequence
  Synthetic
auuuuucuuugcuguccucucc

SEQ ID NO: 15012 - RNA, 23 nt, Artificial Sequence
  Synthetic
gauuuuucuuugcuguccucucc

SEQ ID NO: 15013 - RNA, 24 nt, Artificial Sequence
  Synthetic
ugauuuuucuuugcuguccucucc

SEQ ID NO: 15014 - RNA, 18 nt, Artificial Sequence
  Synthetic
cccggcgcuccugagucc

SEQ ID NO: 15015 - RNA, 19 nt, Artificial Sequence
  Synthetic
ccccggcgcuccugagucc

SEQ ID NO: 15016 - RNA, 20 nt, Artificial Sequence
  Synthetic
cccccggcgcuccugagucc

SEQ ID NO: 15017 - RNA, 21 nt, Artificial Sequence
  Synthetic
gcccccggcgcuccugagucc

SEQ ID NO: 15018 - RNA, 22 nt, Artificial Sequence
  Synthetic
ggcccccggcgcuccugagucc

SEQ ID NO: 15019 - RNA, 23 nt, Artificial Sequence
  Synthetic
gggcccccggcgcuccugagucc

SEQ ID NO: 15020 - RNA, 24 nt, Artificial Sequence
  Synthetic
ggggcccccggcgcuccugagucc

SEQ ID NO: 15021 - RNA, 18 nt, Artificial Sequence
  Synthetic
guacggaggagggugucc

SEQ ID NO: 15022 - RNA, 19 nt, Artificial Sequence
  Synthetic
cguacggaggagggugucc

SEQ ID NO: 15023 - RNA, 20 nt, Artificial Sequence
  Synthetic
gcguacggaggagggugucc

SEQ ID NO: 15024 - RNA, 21 nt, Artificial Sequence
  Synthetic
ugcguacggaggagggugucc

SEQ ID NO: 15025 - RNA, 22 nt, Artificial Sequence
  Synthetic
gugcguacggaggagggugucc

SEQ ID NO: 15026 - RNA, 23 nt, Artificial Sequence
  Synthetic
ugugcguacggaggagggugucc

SEQ ID NO: 15027 - RNA, 24 nt, Artificial Sequence
  Synthetic
gugugcguacggaggagggugucc

SEQ ID NO: 15028 - RNA, 18 nt, Artificial Sequence
  Synthetic
agucuaaaaaacgauucc

SEQ ID NO: 15029 - RNA, 19 nt, Artificial Sequence
  Synthetic
aagucuaaaaaacgauucc

SEQ ID NO: 15030 - RNA, 20 nt, Artificial Sequence
  Synthetic
caagucuaaaaaacgauucc

SEQ ID NO: 15031 - RNA, 21 nt, Artificial Sequence
  Synthetic
acaagucuaaaaaacgauucc

SEQ ID NO: 15032 - RNA, 22 nt, Artificial Sequence
  Synthetic
uacaagucuaaaaaacgauucc

SEQ ID NO: 15033 - RNA, 23 nt, Artificial Sequence
  Synthetic
guacaagucuaaaaaacgauucc

SEQ ID NO: 15034 - RNA, 24 nt, Artificial Sequence
  Synthetic
aguacaagucuaaaaaacgauucc

SEQ ID NO: 15035 - RNA, 18 nt, Artificial Sequence
  Synthetic
cgcccgcgcuuccccagc

SEQ ID NO: 15036 - RNA, 19 nt, Artificial Sequence
  Synthetic
ccgcccgcgcuuccccagc

SEQ ID NO: 15037 - RNA, 20 nt, Artificial Sequence
  Synthetic
uccgcccgcgcuuccccagc

SEQ ID NO: 15038 - RNA, 21 nt, Artificial Sequence
  Synthetic
cuccgcccgcgcuuccccagc

SEQ ID NO: 15039 - RNA, 22 nt, Artificial Sequence
  Synthetic
ccuccgcccgcgcuuccccagc

SEQ ID NO: 15040 - RNA, 23 nt, Artificial Sequence
  Synthetic
cccuccgcccgcgcuuccccagc

SEQ ID NO: 15041 - RNA, 24 nt, Artificial Sequence
  Synthetic
ucccuccgcccgcgcuuccccagc

SEQ ID NO: 15042 - RNA, 18 nt, Artificial Sequence
  Synthetic
cacggucaagugugcagc

SEQ ID NO: 15043 - RNA, 19 nt, Artificial Sequence
  Synthetic
ucacggucaagugugcagc

SEQ ID NO: 15044 - RNA, 20 nt, Artificial Sequence
  Synthetic
cucacggucaagugugcagc

SEQ ID NO: 15045 - RNA, 21 nt, Artificial Sequence
  Synthetic
gcucacggucaagugugcagc

SEQ ID NO: 15046 - RNA, 22 nt, Artificial Sequence
  Synthetic
cgcucacggucaagugugcagc

SEQ ID NO: 15047 - RNA, 23 nt, Artificial Sequence
  Synthetic
gcgcucacggucaagugugcagc

SEQ ID NO: 15048 - RNA, 24 nt, Artificial Sequence
  Synthetic
cgcgcucacggucaagugugcagc

SEQ ID NO: 15049 - RNA, 18 nt, Artificial Sequence
  Synthetic
ccccuggcguccacacgc

SEQ ID NO: 15050 - RNA, 19 nt, Artificial Sequence
  Synthetic
gccccuggcguccacacgc

SEQ ID NO: 15051 - RNA, 20 nt, Artificial Sequence
  Synthetic
ggccccuggcguccacacgc

SEQ ID NO: 15052 - RNA, 21 nt, Artificial Sequence
  Synthetic
cggccccuggcguccacacgc

SEQ ID NO: 15053 - RNA, 22 nt, Artificial Sequence
  Synthetic
ucggccccuggcguccacacgc

SEQ ID NO: 15054 - RNA, 23 nt, Artificial Sequence
  Synthetic
uucggccccuggcguccacacgc

SEQ ID NO: 15055 - RNA, 24 nt, Artificial Sequence
  Synthetic
cuucggccccuggcguccacacgc

SEQ ID NO: 15056 - RNA, 18 nt, Artificial Sequence
  Synthetic
ccccucuuuccaggccgc

SEQ ID NO: 15057 - RNA, 19 nt, Artificial Sequence
  Synthetic
uccccucuuuccaggccgc

SEQ ID NO: 15058 - RNA, 20 nt, Artificial Sequence
  Synthetic
guccccucuuuccaggccgc

SEQ ID NO: 15059 - RNA, 21 nt, Artificial Sequence
  Synthetic
gguccccucuuuccaggccgc

SEQ ID NO: 15060 - RNA, 22 nt, Artificial Sequence
  Synthetic
cgguccccucuuuccaggccgc

SEQ ID NO: 15061 - RNA, 23 nt, Artificial Sequence
  Synthetic
ccgguccccucuuuccaggccgc

SEQ ID NO: 15062 - RNA, 24 nt, Artificial Sequence
  Synthetic
cccgguccccucuuuccaggccgc

SEQ ID NO: 15063 - RNA, 18 nt, Artificial Sequence
  Synthetic
gccgccuuuuguuccggc

SEQ ID NO: 15064 - RNA, 19 nt, Artificial Sequence
  Synthetic
ugccgccuuuuguuccggc

SEQ ID NO: 15065 - RNA, 20 nt, Artificial Sequence
  Synthetic
cugccgccuuuuguuccggc

SEQ ID NO: 15066 - RNA, 21 nt, Artificial Sequence
  Synthetic
acugccgccuuuuguuccggc

SEQ ID NO: 15067 - RNA, 22 nt, Artificial Sequence
  Synthetic
cacugccgccuuuuguuccggc

SEQ ID NO: 15068 - RNA, 23 nt, Artificial Sequence
  Synthetic
gcacugccgccuuuuguuccggc

SEQ ID NO: 15069 - RNA, 24 nt, Artificial Sequence
  Synthetic
ggcacugccgccuuuuguuccggc

SEQ ID NO: 15070 - RNA, 18 nt, Artificial Sequence
  Synthetic
agcgagcgcggcggcggc

SEQ ID NO: 15071 - RNA, 19 nt, Artificial Sequence
  Synthetic
gagcgagcgcggcggcggc

SEQ ID NO: 15072 - RNA, 20 nt, Artificial Sequence
  Synthetic
ggagcgagcgcggcggcggc

SEQ ID NO: 15073 - RNA, 21 nt, Artificial Sequence
  Synthetic
gggagcgagcgcggcggcggc

SEQ ID NO: 15074 - RNA, 22 nt, Artificial Sequence
  Synthetic
ggggagcgagcgcggcggcggc

SEQ ID NO: 15075 - RNA, 23 nt, Artificial Sequence
  Synthetic
cggggagcgagcgcggcggcggc

SEQ ID NO: 15076 - RNA, 24 nt, Artificial Sequence
  Synthetic
gcggggagcgagcgcggcggcggc

SEQ ID NO: 15077 - RNA, 18 nt, Artificial Sequence
  Synthetic
ccgagcgcagccgcgggc

SEQ ID NO: 15078 - RNA, 19 nt, Artificial Sequence
  Synthetic
cccgagcgcagccgcgggc

SEQ ID NO: 15079 - RNA, 20 nt, Artificial Sequence
  Synthetic
ucccgagcgcagccgcgggc

SEQ ID NO: 15080 - RNA, 21 nt, Artificial Sequence
  Synthetic
uucccgagcgcagccgcgggc

SEQ ID NO: 15081 - RNA, 22 nt, Artificial Sequence
  Synthetic
uuucccgagcgcagccgcgggc

SEQ ID NO: 15082 - RNA, 23 nt, Artificial Sequence
  Synthetic
guuucccgagcgcagccgcgggc

SEQ ID NO: 15083 - RNA, 24 nt, Artificial Sequence
  Synthetic
aguuucccgagcgcagccgcgggc

SEQ ID NO: 15084 - RNA, 18 nt, Artificial Sequence
  Synthetic
uccaggccgcgcgggcuc

SEQ ID NO: 15085 - RNA, 19 nt, Artificial Sequence
  Synthetic
uuccaggccgcgcgggcuc

SEQ ID NO: 15086 - RNA, 20 nt, Artificial Sequence
  Synthetic
uuuccaggccgcgcgggcuc

SEQ ID NO: 15087 - RNA, 21 nt, Artificial Sequence
  Synthetic
cuuuccaggccgcgcgggcuc

SEQ ID NO: 15088 - RNA, 22 nt, Artificial Sequence
  Synthetic
ucuuuccaggccgcgcgggcuc

SEQ ID NO: 15089 - RNA, 23 nt, Artificial Sequence
  Synthetic
cucuuuccaggccgcgcgggcuc

SEQ ID NO: 15090 - RNA, 24 nt, Artificial Sequence
  Synthetic
ccucuuuccaggccgcgcgggcuc

SEQ ID NO: 15091 - RNA, 18 nt, Artificial Sequence
  Synthetic
uccugaguccgcggaguc

SEQ ID NO: 15092 - RNA, 19 nt, Artificial Sequence
  Synthetic
cuccugaguccgcggaguc

SEQ ID NO: 15093 - RNA, 20 nt, Artificial Sequence
  Synthetic
gcuccugaguccgcggaguc

SEQ ID NO: 15094 - RNA, 21 nt, Artificial Sequence
  Synthetic
cgcuccugaguccgcggaguc

SEQ ID NO: 15095 - RNA, 22 nt, Artificial Sequence
  Synthetic
gcgcuccugaguccgcggaguc

SEQ ID NO: 15096 - RNA, 23 nt, Artificial Sequence
  Synthetic
ggcgcuccugaguccgcggaguc

SEQ ID NO: 15097 - RNA, 24 nt, Artificial Sequence
  Synthetic
cggcgcuccugaguccgcggaguc

SEQ ID NO: 15098 - RNA, 18 nt, Artificial Sequence
  Synthetic
cguacggaggaggguguc

SEQ ID NO: 15099 - RNA, 19 nt, Artificial Sequence
  Synthetic
gcguacggaggaggguguc

SEQ ID NO: 15100 - RNA, 20 nt, Artificial Sequence
  Synthetic
ugcguacggaggaggguguc

SEQ ID NO: 15101 - RNA, 21 nt, Artificial Sequence
  Synthetic
gugcguacggaggaggguguc

SEQ ID NO: 15102 - RNA, 22 nt, Artificial Sequence
  Synthetic
ugugcguacggaggaggguguc

SEQ ID NO: 15103 - RNA, 23 nt, Artificial Sequence
  Synthetic
gugugcguacggaggaggguguc

SEQ ID NO: 15104 - RNA, 24 nt, Artificial Sequence
  Synthetic
ggugugcguacggaggaggguguc

SEQ ID NO: 15105 - RNA, 18 nt, Artificial Sequence
  Synthetic
aagucuaaaaaacgauuc

SEQ ID NO: 15106 - RNA, 19 nt, Artificial Sequence
  Synthetic
caagucuaaaaaacgauuc

SEQ ID NO: 15107 - RNA, 20 nt, Artificial Sequence
  Synthetic
acaagucuaaaaaacgauuc

SEQ ID NO: 15108 - RNA, 21 nt, Artificial Sequence
  Synthetic
uacaagucuaaaaaacgauuc

SEQ ID NO: 15109 - RNA, 22 nt, Artificial Sequence
  Synthetic
guacaagucuaaaaaacgauuc

SEQ ID NO: 15110 - RNA, 23 nt, Artificial Sequence
  Synthetic
aguacaagucuaaaaaacgauuc

SEQ ID NO: 15111 - RNA, 24 nt, Artificial Sequence
  Synthetic
gaguacaagucuaaaaaacgauuc

SEQ ID NO: 15112 - RNA, 18 nt, Artificial Sequence
  Synthetic
cuccucgggcaaaguuuc

SEQ ID NO: 15113 - RNA, 19 nt, Artificial Sequence
  Synthetic
ucuccucgggcaaaguuuc

SEQ ID NO: 15114 - RNA, 20 nt, Artificial Sequence
  Synthetic
cucuccucgggcaaaguuuc

SEQ ID NO: 15115 - RNA, 21 nt, Artificial Sequence
  Synthetic
ccucuccucgggcaaaguuuc

SEQ ID NO: 15116 - RNA, 22 nt, Artificial Sequence
  Synthetic
uccucuccucgggcaaaguuuc

SEQ ID NO: 15117 - RNA, 23 nt, Artificial Sequence
  Synthetic
guccucuccucgggcaaaguuuc

SEQ ID NO: 15118 - RNA, 24 nt, Artificial Sequence
  Synthetic
uguccucuccucgggcaaaguuuc

SEQ ID NO: 15119 - RNA, 18 nt, Artificial Sequence
  Synthetic
ucacggucaagugugcag

SEQ ID NO: 15120 - RNA, 19 nt, Artificial Sequence
  Synthetic
cucacggucaagugugcag

SEQ ID NO: 15121 - RNA, 20 nt, Artificial Sequence
  Synthetic
gcucacggucaagugugcag

SEQ ID NO: 15122 - RNA, 21 nt, Artificial Sequence
  Synthetic
cgcucacggucaagugugcag

SEQ ID NO: 15123 - RNA, 22 nt, Artificial Sequence
  Synthetic
gcgcucacggucaagugugcag

SEQ ID NO: 15124 - RNA, 23 nt, Artificial Sequence
  Synthetic
cgcgcucacggucaagugugcag

SEQ ID NO: 15125 - RNA, 24 nt, Artificial Sequence
  Synthetic
gcgcgcucacggucaagugugcag

SEQ ID NO: 15126 - RNA, 18 nt, Artificial Sequence
  Synthetic
uucccggggagaaaagag

SEQ ID NO: 15127 - RNA, 19 nt, Artificial Sequence
  Synthetic
auucccggggagaaaagag

SEQ ID NO: 15128 - RNA, 20 nt, Artificial Sequence
  Synthetic
gauucccggggagaaaagag

SEQ ID NO: 15129 - RNA, 21 nt, Artificial Sequence
  Synthetic
cgauucccggggagaaaagag

SEQ ID NO: 15130 - RNA, 22 nt, Artificial Sequence
  Synthetic
acgauucccggggagaaaagag

SEQ ID NO: 15131 - RNA, 23 nt, Artificial Sequence
  Synthetic
aacgauucccggggagaaaagag

SEQ ID NO: 15132 - RNA, 24 nt, Artificial Sequence
  Synthetic
aaacgauucccggggagaaaagag

SEQ ID NO: 15133 - RNA, 18 nt, Artificial Sequence
  Synthetic
gcuccugaguccgcggag

SEQ ID NO: 15134 - RNA, 19 nt, Artificial Sequence
  Synthetic
cgcuccugaguccgcggag

SEQ ID NO: 15135 - RNA, 20 nt, Artificial Sequence
  Synthetic
gcgcuccugaguccgcggag

SEQ ID NO: 15136 - RNA, 21 nt, Artificial Sequence
  Synthetic
ggcgcuccugaguccgcggag

SEQ ID NO: 15137 - RNA, 22 nt, Artificial Sequence
  Synthetic
cggcgcuccugaguccgcggag

SEQ ID NO: 15138 - RNA, 23 nt, Artificial Sequence
  Synthetic
ccggcgcuccugaguccgcggag

SEQ ID NO: 15139 - RNA, 24 nt, Artificial Sequence
  Synthetic
cccggcgcuccugaguccgcggag

SEQ ID NO: 15140 - RNA, 18 nt, Artificial Sequence
  Synthetic
aguccgcggagucgggag

SEQ ID NO: 15141 - RNA, 19 nt, Artificial Sequence
  Synthetic
gaguccgcggagucgggag

SEQ ID NO: 15142 - RNA, 20 nt, Artificial Sequence
  Synthetic
ugaguccgcggagucgggag

SEQ ID NO: 15143 - RNA, 21 nt, Artificial Sequence
  Synthetic
cugaguccgcggagucgggag

SEQ ID NO: 15144 - RNA, 22 nt, Artificial Sequence
  Synthetic
ccugaguccgcggagucgggag

SEQ ID NO: 15145 - RNA, 23 nt, Artificial Sequence
  Synthetic
uccugaguccgcggagucgggag

SEQ ID NO: 15146 - RNA, 24 nt, Artificial Sequence
  Synthetic
cuccugaguccgcggagucgggag

SEQ ID NO: 15147 - RNA, 18 nt, Artificial Sequence
  Synthetic
cgcggcggcggcggggag

SEQ ID NO: 15148 - RNA, 19 nt, Artificial Sequence
  Synthetic
gcgcggcggcggcggggag

SEQ ID NO: 15149 - RNA, 20 nt, Artificial Sequence
  Synthetic
agcgcggcggcggcggggag

SEQ ID NO: 15150 - RNA, 21 nt, Artificial Sequence
  Synthetic
gagcgcggcggcggcggggag

SEQ ID NO: 15151 - RNA, 22 nt, Artificial Sequence
  Synthetic
cgagcgcggcggcggcggggag

SEQ ID NO: 15152 - RNA, 23 nt, Artificial Sequence
  Synthetic
gcgagcgcggcggcggcggggag

SEQ ID NO: 15153 - RNA, 24 nt, Artificial Sequence
  Synthetic
agcgagcgcggcggcggcggggag

SEQ ID NO: 15154 - RNA, 18 nt, Artificial Sequence
  Synthetic
cgcgugugugggggggag

SEQ ID NO: 15155 - RNA, 19 nt, Artificial Sequence
  Synthetic
ccgcgugugugggggggag

SEQ ID NO: 15156 - RNA, 20 nt, Artificial Sequence
  Synthetic
uccgcgugugugggggggag

SEQ ID NO: 15157 - RNA, 21 nt, Artificial Sequence
  Synthetic
guccgcgugugugggggggag

SEQ ID NO: 15158 - RNA, 22 nt, Artificial Sequence
  Synthetic
aguccgcgugugugggggggag

SEQ ID NO: 15159 - RNA, 23 nt, Artificial Sequence
  Synthetic
gaguccgcgugugugggggggag

SEQ ID NO: 15160 - RNA, 24 nt, Artificial Sequence
  Synthetic
agaguccgcgugugugggggggag

SEQ ID NO: 15161 - RNA, 18 nt, Artificial Sequence
  Synthetic
gccccuggcguccacacg

SEQ ID NO: 15162 - RNA, 19 nt, Artificial Sequence
  Synthetic
ggccccuggcguccacacg

SEQ ID NO: 15163 - RNA, 20 nt, Artificial Sequence
  Synthetic
cggccccuggcguccacacg

SEQ ID NO: 15164 - RNA, 21 nt, Artificial Sequence
  Synthetic
ucggccccuggcguccacacg

SEQ ID NO: 15165 - RNA, 22 nt, Artificial Sequence
  Synthetic
uucggccccuggcguccacacg

SEQ ID NO: 15166 - RNA, 23 nt, Artificial Sequence
  Synthetic
cuucggccccuggcguccacacg

SEQ ID NO: 15167 - RNA, 24 nt, Artificial Sequence
  Synthetic
acuucggccccuggcguccacacg

SEQ ID NO: 15168 - RNA, 18 nt, Artificial Sequence
  Synthetic
agaggggccgcggcgacg

SEQ ID NO: 15169 - RNA, 19 nt, Artificial Sequence
  Synthetic
gagaggggccgcggcgacg

SEQ ID NO: 15170 - RNA, 20 nt, Artificial Sequence
  Synthetic
ggagaggggccgcggcgacg

SEQ ID NO: 15171 - RNA, 21 nt, Artificial Sequence
  Synthetic
gggagaggggccgcggcgacg

SEQ ID NO: 15172 - RNA, 22 nt, Artificial Sequence
  Synthetic
cgggagaggggccgcggcgacg

SEQ ID NO: 15173 - RNA, 23 nt, Artificial Sequence
  Synthetic
ucgggagaggggccgcggcgacg

SEQ ID NO: 15174 - RNA, 24 nt, Artificial Sequence
  Synthetic
gucgggagaggggccgcggcgacg

SEQ ID NO: 15175 - RNA, 18 nt, Artificial Sequence
  Synthetic
gaagugggugugcguacg

SEQ ID NO: 15176 - RNA, 19 nt, Artificial Sequence
  Synthetic
ggaagugggugugcguacg

SEQ ID NO: 15177 - RNA, 20 nt, Artificial Sequence
  Synthetic
gggaagugggugugcguacg

SEQ ID NO: 15178 - RNA, 21 nt, Artificial Sequence
  Synthetic
ggggaagugggugugcguacg

SEQ ID NO: 15179 - RNA, 22 nt, Artificial Sequence
  Synthetic
aggggaagugggugugcguacg

SEQ ID NO: 15180 - RNA, 23 nt, Artificial Sequence
  Synthetic
gaggggaagugggugugcguacg

SEQ ID NO: 15181 - RNA, 24 nt, Artificial Sequence
  Synthetic
ggaggggaagugggugugcguacg

SEQ ID NO: 15182 - RNA, 18 nt, Artificial Sequence
  Synthetic
ucuaaaaaacgauucccg

SEQ ID NO: 15183 - RNA, 19 nt, Artificial Sequence
  Synthetic
gucuaaaaaacgauucccg

SEQ ID NO: 15184 - RNA, 20 nt, Artificial Sequence
  Synthetic
agucuaaaaaacgauucccg

SEQ ID NO: 15185 - RNA, 21 nt, Artificial Sequence
  Synthetic
aagucuaaaaaacgauucccg

SEQ ID NO: 15186 - RNA, 22 nt, Artificial Sequence
  Synthetic
caagucuaaaaaacgauucccg

SEQ ID NO: 15187 - RNA, 23 nt, Artificial Sequence
  Synthetic
acaagucuaaaaaacgauucccg

SEQ ID NO: 15188 - RNA, 24 nt, Artificial Sequence
  Synthetic
uacaagucuaaaaaacgauucccg

SEQ ID NO: 15189 - RNA, 18 nt, Artificial Sequence
  Synthetic
cggcgacggggagagccg

SEQ ID NO: 15190 - RNA, 19 nt, Artificial Sequence
  Synthetic
gcggcgacggggagagccg

SEQ ID NO: 15191 - RNA, 20 nt, Artificial Sequence
  Synthetic
cgcggcgacggggagagccg

SEQ ID NO: 15192 - RNA, 21 nt, Artificial Sequence
  Synthetic
ccgcggcgacggggagagccg

SEQ ID NO: 15193 - RNA, 22 nt, Artificial Sequence
  Synthetic
gccgcggcgacggggagagccg

SEQ ID NO: 15194 - RNA, 23 nt, Artificial Sequence
  Synthetic
ggccgcggcgacggggagagccg

SEQ ID NO: 15195 - RNA, 24 nt, Artificial Sequence
  Synthetic
gggccgcggcgacggggagagccg

SEQ ID NO: 15196 - RNA, 18 nt, Artificial Sequence
  Synthetic
cccuggcguccacacgcg

SEQ ID NO: 15197 - RNA, 19 nt, Artificial Sequence
  Synthetic
ccccuggcguccacacgcg

SEQ ID NO: 15198 - RNA, 20 nt, Artificial Sequence
  Synthetic
gccccuggcguccacacgcg

SEQ ID NO: 15199 - RNA, 21 nt, Artificial Sequence
  Synthetic
ggccccuggcguccacacgcg

SEQ ID NO: 15200 - RNA, 22 nt, Artificial Sequence
  Synthetic
cggccccuggcguccacacgcg

SEQ ID NO: 15201 - RNA, 23 nt, Artificial Sequence
  Synthetic
ucggccccuggcguccacacgcg

SEQ ID NO: 15202 - RNA, 24 nt, Artificial Sequence
  Synthetic
uucggccccuggcguccacacgcg

SEQ ID NO: 15203 - RNA, 18 nt, Artificial Sequence
  Synthetic
gggagaggggccgcggcg

SEQ ID NO: 15204 - RNA, 19 nt, Artificial Sequence
  Synthetic
cgggagaggggccgcggcg

SEQ ID NO: 15205 - RNA, 20 nt, Artificial Sequence
  Synthetic
ucgggagaggggccgcggcg

SEQ ID NO: 15206 - RNA, 21 nt, Artificial Sequence
  Synthetic
gucgggagaggggccgcggcg

SEQ ID NO: 15207 - RNA, 22 nt, Artificial Sequence
  Synthetic
agucgggagaggggccgcggcg

SEQ ID NO: 15208 - RNA, 23 nt, Artificial Sequence
  Synthetic
gagucgggagaggggccgcggcg

SEQ ID NO: 15209 - RNA, 24 nt, Artificial Sequence
  Synthetic
ggagucgggagaggggccgcggcg

SEQ ID NO: 15210 - RNA, 18 nt, Artificial Sequence
  Synthetic
ggagcgagcgcggcggcg

SEQ ID NO: 15211 - RNA, 19 nt, Artificial Sequence
  Synthetic
gggagcgagcgcggcggcg

SEQ ID NO: 15212 - RNA, 20 nt, Artificial Sequence
  Synthetic
ggggagcgagcgcggcggcg

SEQ ID NO: 15213 - RNA, 21 nt, Artificial Sequence
  Synthetic
cggggagcgagcgcggcggcg

SEQ ID NO: 15214 - RNA, 22 nt, Artificial Sequence
  Synthetic
gcggggagcgagcgcggcggcg

SEQ ID NO: 15215 - RNA, 23 nt, Artificial Sequence
  Synthetic
cgcggggagcgagcgcggcggcg

SEQ ID NO: 15216 - RNA, 24 nt, Artificial Sequence
  Synthetic
acgcggggagcgagcgcggcggcg

SEQ ID NO: 15217 - RNA, 18 nt, Artificial Sequence
  Synthetic
gcgagcgcggcggcggcg

SEQ ID NO: 15218 - RNA, 19 nt, Artificial Sequence
  Synthetic
agcgagcgcggcggcggcg

SEQ ID NO: 15219 - RNA, 20 nt, Artificial Sequence
  Synthetic
gagcgagcgcggcggcggcg

SEQ ID NO: 15220 - RNA, 21 nt, Artificial Sequence
  Synthetic
ggagcgagcgcggcggcggcg

SEQ ID NO: 15221 - RNA, 22 nt, Artificial Sequence
  Synthetic
gggagcgagcgcggcggcggcg

SEQ ID NO: 15222 - RNA, 23 nt, Artificial Sequence
  Synthetic
ggggagcgagcgcggcggcggcg

SEQ ID NO: 15223 - RNA, 24 nt, Artificial Sequence
  Synthetic
cggggagcgagcgcggcggcggcg

SEQ ID NO: 15224 - RNA, 18 nt, Artificial Sequence
  Synthetic
gccgugggaccgggaagg

SEQ ID NO: 15225 - RNA, 19 nt, Artificial Sequence
  Synthetic
agccgugggaccgggaagg

SEQ ID NO: 15226 - RNA, 20 nt, Artificial Sequence
  Synthetic
gagccgugggaccgggaagg

SEQ ID NO: 15227 - RNA, 21 nt, Artificial Sequence
  Synthetic
agagccgugggaccgggaagg

SEQ ID NO: 15228 - RNA, 22 nt, Artificial Sequence
  Synthetic
gagagccgugggaccgggaagg

SEQ ID NO: 15229 - RNA, 23 nt, Artificial Sequence
  Synthetic
ggagagccgugggaccgggaagg

SEQ ID NO: 15230 - RNA, 24 nt, Artificial Sequence
  Synthetic
gggagagccgugggaccgggaagg

SEQ ID NO: 15231 - RNA, 18 nt, Artificial Sequence
  Synthetic
agaaaauggggggguagg

SEQ ID NO: 15232 - RNA, 19 nt, Artificial Sequence
  Synthetic
aagaaaauggggggguagg

SEQ ID NO: 15233 - RNA, 20 nt, Artificial Sequence
  Synthetic
uaagaaaauggggggguagg

SEQ ID NO: 15234 - RNA, 21 nt, Artificial Sequence
  Synthetic
guaagaaaauggggggguagg

SEQ ID NO: 15235 - RNA, 22 nt, Artificial Sequence
  Synthetic
cguaagaaaauggggggguagg

SEQ ID NO: 15236 - RNA, 23 nt, Artificial Sequence
  Synthetic
ccguaagaaaauggggggguagg

SEQ ID NO: 15237 - RNA, 24 nt, Artificial Sequence
  Synthetic
accguaagaaaauggggggguagg

SEQ ID NO: 15238 - RNA, 18 nt, Artificial Sequence
  Synthetic
aagugggugugcguacgg

SEQ ID NO: 15239 - RNA, 19 nt, Artificial Sequence
  Synthetic
gaagugggugugcguacgg

SEQ ID NO: 15240 - RNA, 20 nt, Artificial Sequence
  Synthetic
ggaagugggugugcguacgg

SEQ ID NO: 15241 - RNA, 21 nt, Artificial Sequence
  Synthetic
gggaagugggugugcguacgg

SEQ ID NO: 15242 - RNA, 22 nt, Artificial Sequence
  Synthetic
ggggaagugggugugcguacgg

SEQ ID NO: 15243 - RNA, 23 nt, Artificial Sequence
  Synthetic
aggggaagugggugugcguacgg

SEQ ID NO: 15244 - RNA, 24 nt, Artificial Sequence
  Synthetic
gaggggaagugggugugcguacgg

SEQ ID NO: 15245 - RNA, 18 nt, Artificial Sequence
  Synthetic
cggucaagugugcagcgg

SEQ ID NO: 15246 - RNA, 19 nt, Artificial Sequence
  Synthetic
acggucaagugugcagcgg

SEQ ID NO: 15247 - RNA, 20 nt, Artificial Sequence
  Synthetic
cacggucaagugugcagcgg

SEQ ID NO: 15248 - RNA, 21 nt, Artificial Sequence
  Synthetic
ucacggucaagugugcagcgg

SEQ ID NO: 15249 - RNA, 22 nt, Artificial Sequence
  Synthetic
cucacggucaagugugcagcgg

SEQ ID NO: 15250 - RNA, 23 nt, Artificial Sequence
  Synthetic
gcucacggucaagugugcagcgg

SEQ ID NO: 15251 - RNA, 24 nt, Artificial Sequence
  Synthetic
cgcucacggucaagugugcagcgg

SEQ ID NO: 15252 - RNA, 18 nt, Artificial Sequence
  Synthetic
gagcgagcgcggcggcgg

SEQ ID NO: 15253 - RNA, 19 nt, Artificial Sequence
  Synthetic
ggagcgagcgcggcggcgg

SEQ ID NO: 15254 - RNA, 20 nt, Artificial Sequence
  Synthetic
gggagcgagcgcggcggcgg

SEQ ID NO: 15255 - RNA, 21 nt, Artificial Sequence
  Synthetic
ggggagcgagcgcggcggcgg

SEQ ID NO: 15256 - RNA, 22 nt, Artificial Sequence
  Synthetic
cggggagcgagcgcggcggcgg

SEQ ID NO: 15257 - RNA, 23 nt, Artificial Sequence
  Synthetic
gcggggagcgagcgcggcggcgg

SEQ ID NO: 15258 - RNA, 24 nt, Artificial Sequence
  Synthetic
cgcggggagcgagcgcggcggcgg

SEQ ID NO: 15259 - RNA, 18 nt, Artificial Sequence
  Synthetic
cugaguccgcggagucgg

SEQ ID NO: 15260 - RNA, 19 nt, Artificial Sequence
  Synthetic
ccugaguccgcggagucgg

SEQ ID NO: 15261 - RNA, 20 nt, Artificial Sequence
  Synthetic
uccugaguccgcggagucgg

SEQ ID NO: 15262 - RNA, 21 nt, Artificial Sequence
  Synthetic
cuccugaguccgcggagucgg

SEQ ID NO: 15263 - RNA, 22 nt, Artificial Sequence
  Synthetic
gcuccugaguccgcggagucgg

SEQ ID NO: 15264 - RNA, 23 nt, Artificial Sequence
  Synthetic
cgcuccugaguccgcggagucgg

SEQ ID NO: 15265 - RNA, 24 nt, Artificial Sequence
  Synthetic
gcgcuccugaguccgcggagucgg

SEQ ID NO: 15266 - RNA, 18 nt, Artificial Sequence
  Synthetic
gaaaauggggggguaggg

SEQ ID NO: 15267 - RNA, 19 nt, Artificial Sequence
  Synthetic
agaaaauggggggguaggg

SEQ ID NO: 15268 - RNA, 20 nt, Artificial Sequence
  Synthetic
aagaaaauggggggguaggg

SEQ ID NO: 15269 - RNA, 21 nt, Artificial Sequence
  Synthetic
uaagaaaauggggggguaggg

SEQ ID NO: 15270 - RNA, 22 nt, Artificial Sequence
  Synthetic
guaagaaaauggggggguaggg

SEQ ID NO: 15271 - RNA, 23 nt, Artificial Sequence
  Synthetic
cguaagaaaauggggggguaggg

SEQ ID NO: 15272 - RNA, 24 nt, Artificial Sequence
  Synthetic
ccguaagaaaauggggggguaggg

SEQ ID NO: 15273 - RNA, 18 nt, Artificial Sequence
  Synthetic
aggggccgcggcgacggg

SEQ ID NO: 15274 - RNA, 19 nt, Artificial Sequence
  Synthetic
gaggggccgcggcgacggg

SEQ ID NO: 15275 - RNA, 20 nt, Artificial Sequence
  Synthetic
agaggggccgcggcgacggg

SEQ ID NO: 15276 - RNA, 21 nt, Artificial Sequence
  Synthetic
gagaggggccgcggcgacggg

SEQ ID NO: 15277 - RNA, 22 nt, Artificial Sequence
  Synthetic
ggagaggggccgcggcgacggg

SEQ ID NO: 15278 - RNA, 23 nt, Artificial Sequence
  Synthetic
gggagaggggccgcggcgacggg

SEQ ID NO: 15279 - RNA, 24 nt, Artificial Sequence
  Synthetic
cgggagaggggccgcggcgacggg

SEQ ID NO: 15280 - RNA, 18 nt, Artificial Sequence
  Synthetic
gagagccgugggaccggg

SEQ ID NO: 15281 - RNA, 19 nt, Artificial Sequence
  Synthetic
ggagagccgugggaccggg

SEQ ID NO: 15282 - RNA, 20 nt, Artificial Sequence
  Synthetic
gggagagccgugggaccggg

SEQ ID NO: 15283 - RNA, 21 nt, Artificial Sequence
  Synthetic
ggggagagccgugggaccggg

SEQ ID NO: 15284 - RNA, 22 nt, Artificial Sequence
  Synthetic
cggggagagccgugggaccggg

SEQ ID NO: 15285 - RNA, 23 nt, Artificial Sequence
  Synthetic
acggggagagccgugggaccggg

SEQ ID NO: 15286 - RNA, 24 nt, Artificial Sequence
  Synthetic
gacggggagagccgugggaccggg

SEQ ID NO: 15287 - RNA, 18 nt, Artificial Sequence
  Synthetic
uaaaaaacgauucccggg

SEQ ID NO: 15288 - RNA, 19 nt, Artificial Sequence
  Synthetic
cuaaaaaacgauucccggg

SEQ ID NO: 15289 - RNA, 20 nt, Artificial Sequence
  Synthetic
ucuaaaaaacgauucccggg

SEQ ID NO: 15290 - RNA, 21 nt, Artificial Sequence
  Synthetic
gucuaaaaaacgauucccggg

SEQ ID NO: 15291 - RNA, 22 nt, Artificial Sequence
  Synthetic
agucuaaaaaacgauucccggg

SEQ ID NO: 15292 - RNA, 23 nt, Artificial Sequence
  Synthetic
aagucuaaaaaacgauucccggg

SEQ ID NO: 15293 - RNA, 24 nt, Artificial Sequence
  Synthetic
caagucuaaaaaacgauucccggg

SEQ ID NO: 15294 - RNA, 18 nt, Artificial Sequence
  Synthetic
ggucaagugugcagcggg

SEQ ID NO: 15295 - RNA, 19 nt, Artificial Sequence
  Synthetic
cggucaagugugcagcggg

SEQ ID NO: 15296 - RNA, 20 nt, Artificial Sequence
  Synthetic
acggucaagugugcagcggg

SEQ ID NO: 15297 - RNA, 21 nt, Artificial Sequence
  Synthetic
cacggucaagugugcagcggg

SEQ ID NO: 15298 - RNA, 22 nt, Artificial Sequence
  Synthetic
ucacggucaagugugcagcggg

SEQ ID NO: 15299 - RNA, 23 nt, Artificial Sequence
  Synthetic
cucacggucaagugugcagcggg

SEQ ID NO: 15300 - RNA, 24 nt, Artificial Sequence
  Synthetic
gcucacggucaagugugcagcggg

SEQ ID NO: 15301 - RNA, 18 nt, Artificial Sequence
  Synthetic
gagcgcggcggcggcggg

SEQ ID NO: 15302 - RNA, 19 nt, Artificial Sequence
  Synthetic
cgagcgcggcggcggcggg

SEQ ID NO: 15303 - RNA, 20 nt, Artificial Sequence
  Synthetic
gcgagcgcggcggcggcggg

SEQ ID NO: 15304 - RNA, 21 nt, Artificial Sequence
  Synthetic
agcgagcgcggcggcggcggg

SEQ ID NO: 15305 - RNA, 22 nt, Artificial Sequence
  Synthetic
gagcgagcgcggcggcggcggg

SEQ ID NO: 15306 - RNA, 23 nt, Artificial Sequence
  Synthetic
ggagcgagcgcggcggcggcggg

SEQ ID NO: 15307 - RNA, 24 nt, Artificial Sequence
  Synthetic
gggagcgagcgcggcggcggcggg

SEQ ID NO: 15308 - RNA, 18 nt, Artificial Sequence
  Synthetic
agcgcggcggcggcgggg

SEQ ID NO: 15309 - RNA, 19 nt, Artificial Sequence
  Synthetic
gagcgcggcggcggcgggg

SEQ ID NO: 15310 - RNA, 20 nt, Artificial Sequence
  Synthetic
cgagcgcggcggcggcgggg

SEQ ID NO: 15311 - RNA, 21 nt, Artificial Sequence
  Synthetic
gcgagcgcggcggcggcgggg

SEQ ID NO: 15312 - RNA, 22 nt, Artificial Sequence
  Synthetic
agcgagcgcggcggcggcgggg

SEQ ID NO: 15313 - RNA, 23 nt, Artificial Sequence
  Synthetic
gagcgagcgcggcggcggcgggg

SEQ ID NO: 15314 - RNA, 24 nt, Artificial Sequence
  Synthetic
ggagcgagcgcggcggcggcgggg

SEQ ID NO: 15315 - RNA, 18 nt, Artificial Sequence
  Synthetic
cguaagaaaauggggggg

SEQ ID NO: 15316 - RNA, 19 nt, Artificial Sequence
  Synthetic
ccguaagaaaauggggggg

SEQ ID NO: 15317 - RNA, 20 nt, Artificial Sequence
  Synthetic
accguaagaaaauggggggg

SEQ ID NO: 15318 - RNA, 21 nt, Artificial Sequence
  Synthetic
caccguaagaaaauggggggg

SEQ ID NO: 15319 - RNA, 22 nt, Artificial Sequence
  Synthetic
ucaccguaagaaaauggggggg

SEQ ID NO: 15320 - RNA, 23 nt, Artificial Sequence
  Synthetic
cucaccguaagaaaauggggggg

SEQ ID NO: 15321 - RNA, 24 nt, Artificial Sequence
  Synthetic
acucaccguaagaaaauggggggg

SEQ ID NO: 15322 - RNA, 18 nt, Artificial Sequence
  Synthetic
cacaugcaaaccuggggg

SEQ ID NO: 15323 - RNA, 19 nt, Artificial Sequence
  Synthetic
ucacaugcaaaccuggggg

SEQ ID NO: 15324 - RNA, 20 nt, Artificial Sequence
  Synthetic
cucacaugcaaaccuggggg

SEQ ID NO: 15325 - RNA, 21 nt, Artificial Sequence
  Synthetic
acucacaugcaaaccuggggg

SEQ ID NO: 15326 - RNA, 22 nt, Artificial Sequence
  Synthetic
aacucacaugcaaaccuggggg

SEQ ID NO: 15327 - RNA, 23 nt, Artificial Sequence
  Synthetic
caacucacaugcaaaccuggggg

SEQ ID NO: 15328 - RNA, 24 nt, Artificial Sequence
  Synthetic
acaacucacaugcaaaccuggggg

SEQ ID NO: 15329 - RNA, 18 nt, Artificial Sequence
  Synthetic
ucacaugcaaaccugggg

SEQ ID NO: 15330 - RNA, 19 nt, Artificial Sequence
  Synthetic
cucacaugcaaaccugggg

SEQ ID NO: 15331 - RNA, 20 nt, Artificial Sequence
  Synthetic
acucacaugcaaaccugggg

SEQ ID NO: 15332 - RNA, 21 nt, Artificial Sequence
  Synthetic
aacucacaugcaaaccugggg

SEQ ID NO: 15333 - RNA, 22 nt, Artificial Sequence
  Synthetic
caacucacaugcaaaccugggg

SEQ ID NO: 15334 - RNA, 23 nt, Artificial Sequence
  Synthetic
acaacucacaugcaaaccugggg

SEQ ID NO: 15335 - RNA, 24 nt, Artificial Sequence
  Synthetic
aacaacucacaugcaaaccugggg

SEQ ID NO: 15336 - RNA, 18 nt, Artificial Sequence
  Synthetic
gaguccgcgugugugggg

SEQ ID NO: 15337 - RNA, 19 nt, Artificial Sequence
  Synthetic
agaguccgcgugugugggg

SEQ ID NO: 15338 - RNA, 20 nt, Artificial Sequence
  Synthetic
uagaguccgcgugugugggg

SEQ ID NO: 15339 - RNA, 21 nt, Artificial Sequence
  Synthetic
uuagaguccgcgugugugggg

SEQ ID NO: 15340 - RNA, 22 nt, Artificial Sequence
  Synthetic
uuuagaguccgcgugugugggg

SEQ ID NO: 15341 - RNA, 23 nt, Artificial Sequence
  Synthetic
uuuuagaguccgcgugugugggg

SEQ ID NO: 15342 - RNA, 24 nt, Artificial Sequence
  Synthetic
auuuuagaguccgcgugugugggg

SEQ ID NO: 15343 - RNA, 18 nt, Artificial Sequence
  Synthetic
agaguccgcguguguggg

SEQ ID NO: 15344 - RNA, 19 nt, Artificial Sequence
  Synthetic
uagaguccgcguguguggg

SEQ ID NO: 15345 - RNA, 20 nt, Artificial Sequence
  Synthetic
uuagaguccgcguguguggg

SEQ ID NO: 15346 - RNA, 21 nt, Artificial Sequence
  Synthetic
uuuagaguccgcguguguggg

SEQ ID NO: 15347 - RNA, 22 nt, Artificial Sequence
  Synthetic
uuuuagaguccgcguguguggg

SEQ ID NO: 15348 - RNA, 23 nt, Artificial Sequence
  Synthetic
auuuuagaguccgcguguguggg

SEQ ID NO: 15349 - RNA, 24 nt, Artificial Sequence
  Synthetic
cauuuuagaguccgcguguguggg

SEQ ID NO: 15350 - RNA, 18 nt, Artificial Sequence
  Synthetic
ccugggggugggagcugg

SEQ ID NO: 15351 - RNA, 19 nt, Artificial Sequence
  Synthetic
accugggggugggagcugg

SEQ ID NO: 15352 - RNA, 20 nt, Artificial Sequence
  Synthetic
aaccugggggugggagcugg

SEQ ID NO: 15353 - RNA, 21 nt, Artificial Sequence
  Synthetic
aaaccugggggugggagcugg

SEQ ID NO: 15354 - RNA, 22 nt, Artificial Sequence
  Synthetic
caaaccugggggugggagcugg

SEQ ID NO: 15355 - RNA, 23 nt, Artificial Sequence
  Synthetic
gcaaaccugggggugggagcugg

SEQ ID NO: 15356 - RNA, 24 nt, Artificial Sequence
  Synthetic
ugcaaaccugggggugggagcugg

SEQ ID NO: 15357 - RNA, 18 nt, Artificial Sequence
  Synthetic
uagaguccgcgugugugg

SEQ ID NO: 15358 - RNA, 19 nt, Artificial Sequence
  Synthetic
uuagaguccgcgugugugg

SEQ ID NO: 15359 - RNA, 20 nt, Artificial Sequence
  Synthetic
uuuagaguccgcgugugugg

SEQ ID NO: 15360 - RNA, 21 nt, Artificial Sequence
  Synthetic
uuuuagaguccgcgugugugg

SEQ ID NO: 15361 - RNA, 22 nt, Artificial Sequence
  Synthetic
auuuuagaguccgcgugugugg

SEQ ID NO: 15362 - RNA, 23 nt, Artificial Sequence
  Synthetic
cauuuuagaguccgcgugugugg

SEQ ID NO: 15363 - RNA, 24 nt, Artificial Sequence
  Synthetic
ucauuuuagaguccgcgugugugg

SEQ ID NO: 15364 - RNA, 18 nt, Artificial Sequence
  Synthetic
acucaccguaagaaaaug

SEQ ID NO: 15365 - RNA, 19 nt, Artificial Sequence
  Synthetic
cacucaccguaagaaaaug

SEQ ID NO: 15366 - RNA, 20 nt, Artificial Sequence
  Synthetic
ccacucaccguaagaaaaug

SEQ ID NO: 15367 - RNA, 21 nt, Artificial Sequence
  Synthetic
cccacucaccguaagaaaaug

SEQ ID NO: 15368 - RNA, 22 nt, Artificial Sequence
  Synthetic
ucccacucaccguaagaaaaug

SEQ ID NO: 15369 - RNA, 23 nt, Artificial Sequence
  Synthetic
uucccacucaccguaagaaaaug

SEQ ID NO: 15370 - RNA, 24 nt, Artificial Sequence
  Synthetic
cuucccacucaccguaagaaaaug

SEQ ID NO: 15371 - RNA, 18 nt, Artificial Sequence
  Synthetic
agugagaaaguggcacug

SEQ ID NO: 15372 - RNA, 19 nt, Artificial Sequence
  Synthetic
uagugagaaaguggcacug

SEQ ID NO: 15373 - RNA, 20 nt, Artificial Sequence
  Synthetic
auagugagaaaguggcacug

SEQ ID NO: 15374 - RNA, 21 nt, Artificial Sequence
  Synthetic
aauagugagaaaguggcacug

SEQ ID NO: 15375 - RNA, 22 nt, Artificial Sequence
  Synthetic
caauagugagaaaguggcacug

SEQ ID NO: 15376 - RNA, 23 nt, Artificial Sequence
  Synthetic
acaauagugagaaaguggcacug

SEQ ID NO: 15377 - RNA, 24 nt, Artificial Sequence
  Synthetic
cacaauagugagaaaguggcacug

SEQ ID NO: 15378 - RNA, 18 nt, Artificial Sequence
  Synthetic
accugggggugggagcug

SEQ ID NO: 15379 - RNA, 19 nt, Artificial Sequence
  Synthetic
aaccugggggugggagcug

SEQ ID NO: 15380 - RNA, 20 nt, Artificial Sequence
  Synthetic
aaaccugggggugggagcug

SEQ ID NO: 15381 - RNA, 21 nt, Artificial Sequence
  Synthetic
caaaccugggggugggagcug

SEQ ID NO: 15382 - RNA, 22 nt, Artificial Sequence
  Synthetic
gcaaaccugggggugggagcug

SEQ ID NO: 15383 - RNA, 23 nt, Artificial Sequence
  Synthetic
ugcaaaccugggggugggagcug

SEQ ID NO: 15384 - RNA, 24 nt, Artificial Sequence
  Synthetic
augcaaaccugggggugggagcug

SEQ ID NO: 15385 - RNA, 18 nt, Artificial Sequence
  Synthetic
accuccccucgcccgcug

SEQ ID NO: 15386 - RNA, 19 nt, Artificial Sequence
  Synthetic
caccuccccucgcccgcug

SEQ ID NO: 15387 - RNA, 20 nt, Artificial Sequence
  Synthetic
ccaccuccccucgcccgcug

SEQ ID NO: 15388 - RNA, 21 nt, Artificial Sequence
  Synthetic
cccaccuccccucgcccgcug

SEQ ID NO: 15389 - RNA, 22 nt, Artificial Sequence
  Synthetic
ucccaccuccccucgcccgcug

SEQ ID NO: 15390 - RNA, 23 nt, Artificial Sequence
  Synthetic
cucccaccuccccucgcccgcug

SEQ ID NO: 15391 - RNA, 24 nt, Artificial Sequence
  Synthetic
ccucccaccuccccucgcccgcug

SEQ ID NO: 15392 - RNA, 18 nt, Artificial Sequence
  Synthetic
ugggggugggagcuggug

SEQ ID NO: 15393 - RNA, 19 nt, Artificial Sequence
  Synthetic
cugggggugggagcuggug

SEQ ID NO: 15394 - RNA, 20 nt, Artificial Sequence
  Synthetic
ccugggggugggagcuggug

SEQ ID NO: 15395 - RNA, 21 nt, Artificial Sequence
  Synthetic
accugggggugggagcuggug

SEQ ID NO: 15396 - RNA, 22 nt, Artificial Sequence
  Synthetic
aaccugggggugggagcuggug

SEQ ID NO: 15397 - RNA, 23 nt, Artificial Sequence
  Synthetic
aaaccugggggugggagcuggug

SEQ ID NO: 15398 - RNA, 24 nt, Artificial Sequence
  Synthetic
caaaccugggggugggagcuggug

SEQ ID NO: 15399 - RNA, 18 nt, Artificial Sequence
  Synthetic
uuuuagaguccgcgugug

SEQ ID NO: 15400 - RNA, 19 nt, Artificial Sequence
  Synthetic
auuuuagaguccgcgugug

SEQ ID NO: 15401 - RNA, 20 nt, Artificial Sequence
  Synthetic
cauuuuagaguccgcgugug

SEQ ID NO: 15402 - RNA, 21 nt, Artificial Sequence
  Synthetic
ucauuuuagaguccgcgugug

SEQ ID NO: 15403 - RNA, 22 nt, Artificial Sequence
  Synthetic
uucauuuuagaguccgcgugug

SEQ ID NO: 15404 - RNA, 23 nt, Artificial Sequence
  Synthetic
uuucauuuuagaguccgcgugug

SEQ ID NO: 15405 - RNA, 24 nt, Artificial Sequence
  Synthetic
cuuucauuuuagaguccgcgugug

SEQ ID NO: 15406 - RNA, 18 nt, Artificial Sequence
  Synthetic
uuagaguccgcgugugug

SEQ ID NO: 15407 - RNA, 19 nt, Artificial Sequence
  Synthetic
uuuagaguccgcgugugug

SEQ ID NO: 15408 - RNA, 20 nt, Artificial Sequence
  Synthetic
uuuuagaguccgcgugugug

SEQ ID NO: 15409 - RNA, 21 nt, Artificial Sequence
  Synthetic
auuuuagaguccgcgugugug

SEQ ID NO: 15410 - RNA, 22 nt, Artificial Sequence
  Synthetic
cauuuuagaguccgcgugugug

SEQ ID NO: 15411 - RNA, 23 nt, Artificial Sequence
  Synthetic
ucauuuuagaguccgcgugugug

SEQ ID NO: 15412 - RNA, 24 nt, Artificial Sequence
  Synthetic
uucauuuuagaguccgcgugugug

SEQ ID NO: 15413 - RNA, 18 nt, Artificial Sequence
  Synthetic
cacucaccguaagaaaau

SEQ ID NO: 15414 - RNA, 19 nt, Artificial Sequence
  Synthetic
ccacucaccguaagaaaau

SEQ ID NO: 15415 - RNA, 20 nt, Artificial Sequence
  Synthetic
cccacucaccguaagaaaau

SEQ ID NO: 15416 - RNA, 21 nt, Artificial Sequence
  Synthetic
ucccacucaccguaagaaaau

SEQ ID NO: 15417 - RNA, 22 nt, Artificial Sequence
  Synthetic
uucccacucaccguaagaaaau

SEQ ID NO: 15418 - RNA, 23 nt, Artificial Sequence
  Synthetic
cuucccacucaccguaagaaaau

SEQ ID NO: 15419 - RNA, 24 nt, Artificial Sequence
  Synthetic
gcuucccacucaccguaagaaaau

SEQ ID NO: 15420 - RNA, 18 nt, Artificial Sequence
  Synthetic
cgcugcggagcuguaacu

SEQ ID NO: 15421 - RNA, 19 nt, Artificial Sequence
  Synthetic
ccgcugcggagcuguaacu

SEQ ID NO: 15422 - RNA, 20 nt, Artificial Sequence
  Synthetic
cccgcugcggagcuguaacu

SEQ ID NO: 15423 - RNA, 21 nt, Artificial Sequence
  Synthetic
gcccgcugcggagcuguaacu

SEQ ID NO: 15424 - RNA, 22 nt, Artificial Sequence
  Synthetic
cgcccgcugcggagcuguaacu

SEQ ID NO: 15425 - RNA, 23 nt, Artificial Sequence
  Synthetic
ucgcccgcugcggagcuguaacu

SEQ ID NO: 15426 - RNA, 24 nt, Artificial Sequence
  Synthetic
cucgcccgcugcggagcuguaacu

SEQ ID NO: 15427 - RNA, 18 nt, Artificial Sequence
  Synthetic
uagugagaaaguggcacu

SEQ ID NO: 15428 - RNA, 19 nt, Artificial Sequence
  Synthetic
auagugagaaaguggcacu

SEQ ID NO: 15429 - RNA, 20 nt, Artificial Sequence
  Synthetic
aauagugagaaaguggcacu

SEQ ID NO: 15430 - RNA, 21 nt, Artificial Sequence
  Synthetic
caauagugagaaaguggcacu

SEQ ID NO: 15431 - RNA, 22 nt, Artificial Sequence
  Synthetic
acaauagugagaaaguggcacu

SEQ ID NO: 15432 - RNA, 23 nt, Artificial Sequence
  Synthetic
cacaauagugagaaaguggcacu

SEQ ID NO: 15433 - RNA, 24 nt, Artificial Sequence
  Synthetic
ccacaauagugagaaaguggcacu

SEQ ID NO: 15434 - RNA, 18 nt, Artificial Sequence
  Synthetic
cggucccuggcucggccu

SEQ ID NO: 15435 - RNA, 19 nt, Artificial Sequence
  Synthetic
ccggucccuggcucggccu

SEQ ID NO: 15436 - RNA, 20 nt, Artificial Sequence
  Synthetic
cccggucccuggcucggccu

SEQ ID NO: 15437 - RNA, 18 nt, Artificial Sequence
  Synthetic
caccuccccucgcccgcu

SEQ ID NO: 15438 - RNA, 19 nt, Artificial Sequence
  Synthetic
ccaccuccccucgcccgcu

SEQ ID NO: 15439 - RNA, 20 nt, Artificial Sequence
  Synthetic
cccaccuccccucgcccgcu

SEQ ID NO: 15440 - RNA, 21 nt, Artificial Sequence
  Synthetic
ucccaccuccccucgcccgcu

SEQ ID NO: 15441 - RNA, 22 nt, Artificial Sequence
  Synthetic
cucccaccuccccucgcccgcu

SEQ ID NO: 15442 - RNA, 23 nt, Artificial Sequence
  Synthetic
ccucccaccuccccucgcccgcu

SEQ ID NO: 15443 - RNA, 24 nt, Artificial Sequence
  Synthetic
cccucccaccuccccucgcccgcu

SEQ ID NO: 15444 - RNA, 18 nt, Artificial Sequence
  Synthetic
cgagcgcagccgcgggcu

SEQ ID NO: 15445 - RNA, 19 nt, Artificial Sequence
  Synthetic
ccgagcgcagccgcgggcu

SEQ ID NO: 15446 - RNA, 20 nt, Artificial Sequence
  Synthetic
cccgagcgcagccgcgggcu

SEQ ID NO: 15447 - RNA, 21 nt, Artificial Sequence
  Synthetic
ucccgagcgcagccgcgggcu

SEQ ID NO: 15448 - RNA, 22 nt, Artificial Sequence
  Synthetic
uucccgagcgcagccgcgggcu

SEQ ID NO: 15449 - RNA, 23 nt, Artificial Sequence
  Synthetic
uuucccgagcgcagccgcgggcu

SEQ ID NO: 15450 - RNA, 24 nt, Artificial Sequence
  Synthetic
guuucccgagcgcagccgcgggcu

SEQ ID NO: 15451 - RNA, 18 nt, Artificial Sequence
  Synthetic
cuccugaguccgcggagu

SEQ ID NO: 15452 - RNA, 19 nt, Artificial Sequence
  Synthetic
gcuccugaguccgcggagu

SEQ ID NO: 15453 - RNA, 20 nt, Artificial Sequence
  Synthetic
cgcuccugaguccgcggagu

SEQ ID NO: 15454 - RNA, 21 nt, Artificial Sequence
  Synthetic
gcgcuccugaguccgcggagu

SEQ ID NO: 15455 - RNA, 22 nt, Artificial Sequence
  Synthetic
ggcgcuccugaguccgcggagu

SEQ ID NO: 15456 - RNA, 23 nt, Artificial Sequence
  Synthetic
cggcgcuccugaguccgcggagu

SEQ ID NO: 15457 - RNA, 24 nt, Artificial Sequence
  Synthetic
ccggcgcuccugaguccgcggagu

SEQ ID NO: 15458 - RNA, 18 nt, Artificial Sequence
  Synthetic
agucauccccacaauagu

SEQ ID NO: 15459 - RNA, 19 nt, Artificial Sequence
  Synthetic
uagucauccccacaauagu

SEQ ID NO: 15460 - RNA, 20 nt, Artificial Sequence
  Synthetic
guagucauccccacaauagu

SEQ ID NO: 15461 - RNA, 21 nt, Artificial Sequence
  Synthetic
aguagucauccccacaauagu

SEQ ID NO: 15462 - RNA, 22 nt, Artificial Sequence
  Synthetic
aaguagucauccccacaauagu

SEQ ID NO: 15463 - RNA, 23 nt, Artificial Sequence
  Synthetic
aaaguagucauccccacaauagu

SEQ ID NO: 15464 - RNA, 24 nt, Artificial Sequence
  Synthetic
gaaaguagucauccccacaauagu

SEQ ID NO: 15465 - RNA, 18 nt, Artificial Sequence
  Synthetic
uugcuucccacucaccgu

SEQ ID NO: 15466 - RNA, 19 nt, Artificial Sequence
  Synthetic
guugcuucccacucaccgu

SEQ ID NO: 15467 - RNA, 20 nt, Artificial Sequence
  Synthetic
gguugcuucccacucaccgu

SEQ ID NO: 15468 - RNA, 21 nt, Artificial Sequence
  Synthetic
agguugcuucccacucaccgu

SEQ ID NO: 15469 - RNA, 22 nt, Artificial Sequence
  Synthetic
gagguugcuucccacucaccgu

SEQ ID NO: 15470 - RNA, 23 nt, Artificial Sequence
  Synthetic
ggagguugcuucccacucaccgu

SEQ ID NO: 15471 - RNA, 24 nt, Artificial Sequence
  Synthetic
gggagguugcuucccacucaccgu

SEQ ID NO: 15472 - RNA, 18 nt, Artificial Sequence
  Synthetic
ggggaagugggugugcgu

SEQ ID NO: 15473 - RNA, 19 nt, Artificial Sequence
  Synthetic
aggggaagugggugugcgu

SEQ ID NO: 15474 - RNA, 20 nt, Artificial Sequence
  Synthetic
gaggggaagugggugugcgu

SEQ ID NO: 15475 - RNA, 21 nt, Artificial Sequence
  Synthetic
ggaggggaagugggugugcgu

SEQ ID NO: 15476 - RNA, 22 nt, Artificial Sequence
  Synthetic
gggaggggaagugggugugcgu

SEQ ID NO: 15477 - RNA, 23 nt, Artificial Sequence
  Synthetic
ggggaggggaagugggugugcgu

SEQ ID NO: 15478 - RNA, 24 nt, Artificial Sequence
  Synthetic
cggggaggggaagugggugugcgu

SEQ ID NO: 15479 - RNA, 18 nt, Artificial Sequence
  Synthetic
guaagaaaaugggggggu

SEQ ID NO: 15480 - RNA, 19 nt, Artificial Sequence
  Synthetic
cguaagaaaaugggggggu

SEQ ID NO: 15481 - RNA, 20 nt, Artificial Sequence
  Synthetic
ccguaagaaaaugggggggu

SEQ ID NO: 15482 - RNA, 21 nt, Artificial Sequence
  Synthetic
accguaagaaaaugggggggu

SEQ ID NO: 15483 - RNA, 22 nt, Artificial Sequence
  Synthetic
caccguaagaaaaugggggggu

SEQ ID NO: 15484 - RNA, 23 nt, Artificial Sequence
  Synthetic
ucaccguaagaaaaugggggggu

SEQ ID NO: 15485 - RNA, 24 nt, Artificial Sequence
  Synthetic
cucaccguaagaaaaugggggggu

SEQ ID NO: 15486 - RNA, 18 nt, Artificial Sequence
  Synthetic
acaugcaaaccugggggu

SEQ ID NO: 15487 - RNA, 19 nt, Artificial Sequence
  Synthetic
cacaugcaaaccugggggu

SEQ ID NO: 15488 - RNA, 20 nt, Artificial Sequence
  Synthetic
ucacaugcaaaccugggggu

SEQ ID NO: 15489 - RNA, 21 nt, Artificial Sequence
  Synthetic
cucacaugcaaaccugggggu

SEQ ID NO: 15490 - RNA, 22 nt, Artificial Sequence
  Synthetic
acucacaugcaaaccugggggu

SEQ ID NO: 15491 - RNA, 23 nt, Artificial Sequence
  Synthetic
aacucacaugcaaaccugggggu

SEQ ID NO: 15492 - RNA, 24 nt, Artificial Sequence
  Synthetic
caacucacaugcaaaccugggggu

SEQ ID NO: 15493 - RNA, 18 nt, Artificial Sequence
  Synthetic
cugggggugggagcuggu

SEQ ID NO: 15494 - RNA, 19 nt, Artificial Sequence
  Synthetic
ccugggggugggagcuggu

SEQ ID NO: 15495 - RNA, 20 nt, Artificial Sequence
  Synthetic
accugggggugggagcuggu

SEQ ID NO: 15496 - RNA, 21 nt, Artificial Sequence
  Synthetic
aaccugggggugggagcuggu

SEQ ID NO: 15497 - RNA, 22 nt, Artificial Sequence
  Synthetic
aaaccugggggugggagcuggu

SEQ ID NO: 15498 - RNA, 23 nt, Artificial Sequence
  Synthetic
caaaccugggggugggagcuggu

SEQ ID NO: 15499 - RNA, 24 nt, Artificial Sequence
  Synthetic
gcaaaccugggggugggagcuggu

SEQ ID NO: 15500 - RNA, 18 nt, Artificial Sequence
  Synthetic
auuuuagaguccgcgugu

SEQ ID NO: 15501 - RNA, 19 nt, Artificial Sequence
  Synthetic
cauuuuagaguccgcgugu

SEQ ID NO: 15502 - RNA, 20 nt, Artificial Sequence
  Synthetic
ucauuuuagaguccgcgugu

SEQ ID NO: 15503 - RNA, 21 nt, Artificial Sequence
  Synthetic
uucauuuuagaguccgcgugu

SEQ ID NO: 15504 - RNA, 22 nt, Artificial Sequence
  Synthetic
uuucauuuuagaguccgcgugu

SEQ ID NO: 15505 - RNA, 23 nt, Artificial Sequence
  Synthetic
cuuucauuuuagaguccgcgugu

SEQ ID NO: 15506 - RNA, 24 nt, Artificial Sequence
  Synthetic
ucuuucauuuuagaguccgcgugu

SEQ ID NO: 15507 - RNA, 18 nt, Artificial Sequence
  Synthetic
gcguacggaggagggugu

SEQ ID NO: 15508 - RNA, 19 nt, Artificial Sequence
  Synthetic
ugcguacggaggagggugu

SEQ ID NO: 15509 - RNA, 20 nt, Artificial Sequence
  Synthetic
gugcguacggaggagggugu

SEQ ID NO: 15510 - RNA, 21 nt, Artificial Sequence
  Synthetic
ugugcguacggaggagggugu

SEQ ID NO: 15511 - RNA, 22 nt, Artificial Sequence
  Synthetic
gugugcguacggaggagggugu

SEQ ID NO: 15512 - RNA, 23 nt, Artificial Sequence
  Synthetic
ggugugcguacggaggagggugu

SEQ ID NO: 15513 - RNA, 24 nt, Artificial Sequence
  Synthetic
gggugugcguacggaggagggugu

SEQ ID NO: 15514 - RNA, 18 nt, Artificial Sequence
  Synthetic
uuuagaguccgcgugugu

SEQ ID NO: 15515 - RNA, 19 nt, Artificial Sequence
  Synthetic
uuuuagaguccgcgugugu

SEQ ID NO: 15516 - RNA, 20 nt, Artificial Sequence
  Synthetic
auuuuagaguccgcgugugu

SEQ ID NO: 15517 - RNA, 21 nt, Artificial Sequence
  Synthetic
cauuuuagaguccgcgugugu

SEQ ID NO: 15518 - RNA, 22 nt, Artificial Sequence
  Synthetic
ucauuuuagaguccgcgugugu

SEQ ID NO: 15519 - RNA, 23 nt, Artificial Sequence
  Synthetic
uucauuuuagaguccgcgugugu

SEQ ID NO: 15520 - RNA, 24 nt, Artificial Sequence
  Synthetic
uuucauuuuagaguccgcgugugu

SEQ ID NO: 15521 - RNA, 18 nt, Artificial Sequence
  Synthetic
gacuugggcgcugcccuu

SEQ ID NO: 15522 - RNA, 19 nt, Artificial Sequence
  Synthetic
agacuugggcgcugcccuu

SEQ ID NO: 15523 - RNA, 20 nt, Artificial Sequence
  Synthetic
gagacuugggcgcugcccuu

SEQ ID NO: 15524 - RNA, 21 nt, Artificial Sequence
  Synthetic
ggagacuugggcgcugcccuu

SEQ ID NO: 15525 - RNA, 22 nt, Artificial Sequence
  Synthetic
uggagacuugggcgcugcccuu

SEQ ID NO: 15526 - RNA, 23 nt, Artificial Sequence
  Synthetic
cuggagacuugggcgcugcccuu

SEQ ID NO: 15527 - RNA, 24 nt, Artificial Sequence
  Synthetic
ccuggagacuugggcgcugcccuu

SEQ ID NO: 15528 - RNA, 18 nt, Artificial Sequence
  Synthetic
ggucccuggcucggccuu

SEQ ID NO: 15529 - RNA, 19 nt, Artificial Sequence
  Synthetic
cggucccuggcucggccuu

SEQ ID NO: 15530 - RNA, 20 nt, Artificial Sequence
  Synthetic
ccggucccuggcucggccuu

SEQ ID NO: 15531 - RNA, 18 nt, Artificial Sequence
  Synthetic
aagaggugagacuggcuu

SEQ ID NO: 15532 - RNA, 19 nt, Artificial Sequence
  Synthetic
aaagaggugagacuggcuu

SEQ ID NO: 15533 - RNA, 20 nt, Artificial Sequence
  Synthetic
aaaagaggugagacuggcuu

SEQ ID NO: 15534 - RNA, 21 nt, Artificial Sequence
  Synthetic
gaaaagaggugagacuggcuu

SEQ ID NO: 15535 - RNA, 22 nt, Artificial Sequence
  Synthetic
agaaaagaggugagacuggcuu

SEQ ID NO: 15536 - RNA, 23 nt, Artificial Sequence
  Synthetic
gagaaaagaggugagacuggcuu

SEQ ID NO: 15537 - RNA, 24 nt, Artificial Sequence
  Synthetic
ggagaaaagaggugagacuggcuu

SEQ ID NO: 15538 - RNA, 18 nt, Artificial Sequence
  Synthetic
augaacaaugcuaagguu

SEQ ID NO: 15539 - RNA, 19 nt, Artificial Sequence
  Synthetic
aaugaacaaugcuaagguu

SEQ ID NO: 15540 - RNA, 20 nt, Artificial Sequence
  Synthetic
uaaugaacaaugcuaagguu

SEQ ID NO: 15541 - RNA, 21 nt, Artificial Sequence
  Synthetic
auaaugaacaaugcuaagguu

SEQ ID NO: 15542 - RNA, 22 nt, Artificial Sequence
  Synthetic
aauaaugaacaaugcuaagguu

SEQ ID NO: 15543 - RNA, 23 nt, Artificial Sequence
  Synthetic
aaauaaugaacaaugcuaagguu

SEQ ID NO: 15544 - RNA, 24 nt, Artificial Sequence
  Synthetic
aaaauaaugaacaaugcuaagguu

SEQ ID NO: 15545 - RNA, 18 nt, Artificial Sequence
  Synthetic
gccgcuuuauuucucuuu

SEQ ID NO: 15546 - RNA, 19 nt, Artificial Sequence
  Synthetic
cgccgcuuuauuucucuuu

SEQ ID NO: 15547 - RNA, 20 nt, Artificial Sequence
  Synthetic
ccgccgcuuuauuucucuuu

SEQ ID NO: 15548 - RNA, 21 nt, Artificial Sequence
  Synthetic
uccgccgcuuuauuucucuuu

SEQ ID NO: 15549 - RNA, 22 nt, Artificial Sequence
  Synthetic
uuccgccgcuuuauuucucuuu

SEQ ID NO: 15550 - RNA, 23 nt, Artificial Sequence
  Synthetic
uuuccgccgcuuuauuucucuuu

SEQ ID NO: 15551 - RNA, 24 nt, Artificial Sequence
  Synthetic
cuuuccgccgcuuuauuucucuuu

SEQ ID NO: 15552 - RNA, 17 nt, Artificial Sequence
  Synthetic
acacaccccucucuccc

SEQ ID NO: 15553 - RNA, 17 nt, Artificial Sequence
  Synthetic
cuuacgcgagaauuccc

SEQ ID NO: 15554 - RNA, 17 nt, Artificial Sequence
  Synthetic
cccucucucccccucgc

SEQ ID NO: 15555 - RNA, 17 nt, Artificial Sequence
  Synthetic
ucuaguccugcgcgcuc

SEQ ID NO: 15556 - RNA, 17 nt, Artificial Sequence
  Synthetic
uugaacuugcagcucag

SEQ ID NO: 15557 - RNA, 17 nt, Artificial Sequence
  Synthetic
uuaagugcugggguuug

SEQ ID NO: 15558 - RNA, 17 nt, Artificial Sequence
  Synthetic
cacgcggacucuaaaau

SEQ ID NO: 15559 - RNA, 17 nt, Artificial Sequence
  Synthetic
aauugugggagagccgu

SEQ ID NO: 15560 - RNA, 17 nt, Artificial Sequence
  Synthetic
gauguguguccauuggu

SEQ ID NO: 15561 - RNA, 20 nt, Artificial Sequence
  Synthetic
ugcacacaccccucucuccc

SEQ ID NO: 15562 - RNA, 20 nt, Artificial Sequence
  Synthetic
uuacuuacgcgagaauuccc

SEQ ID NO: 15563 - RNA, 20 nt, Artificial Sequence
  Synthetic
caccccucucucccccucgc

SEQ ID NO: 15564 - RNA, 20 nt, Artificial Sequence
  Synthetic
gcuucuaguccugcgcgcuc

SEQ ID NO: 15565 - RNA, 20 nt, Artificial Sequence
  Synthetic
cacuugaacuugcagcucag

SEQ ID NO: 15566 - RNA, 20 nt, Artificial Sequence
  Synthetic
ugcuuaagugcugggguuug

SEQ ID NO: 15567 - RNA, 20 nt, Artificial Sequence
  Synthetic
augaauugugggagagccgu

SEQ ID NO: 15568 - RNA, 20 nt, Artificial Sequence
  Synthetic
ccugauguguguccauuggu

SEQ ID NO: 15569 - RNA, 17 nt, Artificial Sequence
  Synthetic
cccuccccgcacuggcc

SEQ ID NO: 15570 - RNA, 17 nt, Artificial Sequence
  Synthetic
uuuuuuuuuuuuuuuuu

SEQ ID NO: 15571 - RNA, 20 nt, Artificial Sequence
  Synthetic
ucccccuccccgcacuggcc

SEQ ID NO: 15572 - RNA, 20 nt, Artificial Sequence
  Synthetic
acacacgcggacucuaaaau

SEQ ID NO: 15573 - RNA, 20 nt, Artificial Sequence
  Synthetic
uuuuuuuuuuuuuuuuuuuu

SEQ ID NO: 15574 - RNA, 17 nt, Artificial Sequence
  Synthetic
gugaguacaagucuaaa

SEQ ID NO: 15575 - RNA, 17 nt, Artificial Sequence
  Synthetic
gcugguggggaaaggga

SEQ ID NO: 15576 - RNA, 17 nt, Artificial Sequence
  Synthetic
guccgggagcaacucua

SEQ ID NO: 15577 - RNA, 17 nt, Artificial Sequence
  Synthetic
ccuuuugugccggcucc

SEQ ID NO: 15578 - RNA, 17 nt, Artificial Sequence
  Synthetic
accuggcuucccuccgc

SEQ ID NO: 15579 - RNA, 17 nt, Artificial Sequence
  Synthetic
gcucagcucucaacuuc

SEQ ID NO: 15580 - RNA, 17 nt, Artificial Sequence
  Synthetic
uccucuuuccuccuuuc

SEQ ID NO: 15581 - RNA, 17 nt, Artificial Sequence
  Synthetic
gggagaaaagaggugag

SEQ ID NO: 15582 - RNA, 17 nt, Artificial Sequence
  Synthetic
cagcccuccaaacuuag

SEQ ID NO: 15583 - RNA, 17 nt, Artificial Sequence
  Synthetic
cuuuucgaaaaggaaug

SEQ ID NO: 15584 - RNA, 17 nt, Artificial Sequence
  Synthetic
cacgcggacucuaaaau

SEQ ID NO: 15585 - RNA, 17 nt, Artificial Sequence
  Synthetic
gagcgcagccgcgggcu

SEQ ID NO: 15586 - RNA, 20 nt, Artificial Sequence
  Synthetic
ggagugaguacaagucuaaa

SEQ ID NO: 15587 - RNA, 20 nt, Artificial Sequence
  Synthetic
ggagcugguggggaaaggga

SEQ ID NO: 15588 - RNA, 20 nt, Artificial Sequence
  Synthetic
gguguccgggagcaacucua

SEQ ID NO: 15589 - RNA, 20 nt, Artificial Sequence
  Synthetic
cugccuuuugugccggcucc

SEQ ID NO: 15590 - RNA, 20 nt, Artificial Sequence
  Synthetic
ucuaccuggcuucccuccgc

SEQ ID NO: 15591 - RNA, 20 nt, Artificial Sequence
  Synthetic
gaggcucagcucucaacuuc

SEQ ID NO: 15592 - RNA, 20 nt, Artificial Sequence
  Synthetic
uccuccucuuuccuccuuuc

SEQ ID NO: 15593 - RNA, 20 nt, Artificial Sequence
  Synthetic
ccggggagaaaagaggugag

SEQ ID NO: 15594 - RNA, 20 nt, Artificial Sequence
  Synthetic
ccgcagcccuccaaacuuag

SEQ ID NO: 15595 - RNA, 20 nt, Artificial Sequence
  Synthetic
ucucuuuucgaaaaggaaug

SEQ ID NO: 15596 - RNA, 20 nt, Artificial Sequence
  Synthetic
acacacgcggacucuaaaau

SEQ ID NO: 15597 - RNA, 20 nt, Artificial Sequence
  Synthetic
cccgagcgcagccgcgggcu

SEQ ID NO: 15598 - RNA, 17 nt, Artificial Sequence
  Synthetic
gcacuaggugaaaucuc

SEQ ID NO: 15599 - RNA, 17 nt, Artificial Sequence
  Synthetic
gaaagcaguguaaggcu

SEQ ID NO: 15600 - RNA, 20 nt, Artificial Sequence
  Synthetic
guaauuaagaaagcagugua

SEQ ID NO: 15601 - RNA, 20 nt, Artificial Sequence
  Synthetic
guugcacuaggugaaaucuc

SEQ ID NO: 15602 - RNA, 20 nt, Artificial Sequence
  Synthetic
ggcuguuuuggaauguagag

SEQ ID NO: 15603 - RNA, 17 nt, Artificial Sequence
  Synthetic
ggcuguuuuuggaucuu

SEQ ID NO: 15604 - RNA, 20 nt, Artificial Sequence
  Synthetic
gugcuacuuauacaauucac

SEQ ID NO: 15605 - RNA, 20 nt, Artificial Sequence
  Synthetic
gaaaauacuuacuguacugc

SEQ ID NO: 15606 - RNA, 17 nt, Artificial Sequence
  Synthetic
auuaagaaagcagugua

SEQ ID NO: 15607 - RNA, 17 nt, Artificial Sequence
  Synthetic
auuuuacuagugaauua

SEQ ID NO: 15608 - RNA, 17 nt, Artificial Sequence
  Synthetic
auuuaagacgggaaaac

SEQ ID NO: 15609 - RNA, 17 nt, Artificial Sequence
  Synthetic
agaaagcaguguaaggc

SEQ ID NO: 15610 - RNA, 17 nt, Artificial Sequence
  Synthetic
uguuuuggaauguagag

SEQ ID NO: 15611 - RNA, 17 nt, Artificial Sequence
  Synthetic
acaacuuguguugcacu

SEQ ID NO: 15612 - RNA, 20 nt, Artificial Sequence
  Synthetic
ucucacauaaaaauuuaaga

SEQ ID NO: 15613 - RNA, 20 nt, Artificial Sequence
  Synthetic
uuggaauguagagaggcaga

SEQ ID NO: 15614 - RNA, 20 nt, Artificial Sequence
  Synthetic
auuauuuuacuagugaauua

SEQ ID NO: 15615 - RNA, 20 nt, Artificial Sequence
  Synthetic
aaaauuuaagacgggaaaac

SEQ ID NO: 15616 - RNA, 20 nt, Artificial Sequence
  Synthetic
cucacauaaaaauuuaagac

SEQ ID NO: 15617 - RNA, 20 nt, Artificial Sequence
  Synthetic
uacacaacuuguguugcacu

SEQ ID NO: 15618 - RNA, 20 nt, Artificial Sequence
  Synthetic
uaagaaagcaguguaaggcu

SEQ ID NO: 15619 - RNA, 20 nt, Artificial Sequence
  Synthetic
auuagaauaaaaggcuguuu

SEQ ID NO: 15620 - RNA, 17 nt, Artificial Sequence
  Synthetic
uauuuacagccauaaca

SEQ ID NO: 15621 - RNA, 17 nt, Artificial Sequence
  Synthetic
auacuuacuguacugca

SEQ ID NO: 15622 - RNA, 17 nt, Artificial Sequence
  Synthetic
cacuggaaacccuguua

SEQ ID NO: 15623 - RNA, 17 nt, Artificial Sequence
  Synthetic
cuauuuacagccauaac

SEQ ID NO: 15624 - RNA, 17 nt, Artificial Sequence
  Synthetic
cuacuuauacaauucac

SEQ ID NO: 15625 - RNA, 17 nt, Artificial Sequence
  Synthetic
aauacuuacuguacugc

SEQ ID NO: 15626 - RNA, 17 nt, Artificial Sequence
  Synthetic
uacuuacuguacugcag

SEQ ID NO: 15627 - RNA, 17 nt, Artificial Sequence
  Synthetic
uguacugcaggggaauu

SEQ ID NO: 15628 - RNA, 17 nt, Artificial Sequence
  Synthetic
uggguagcaguggcuuu

SEQ ID NO: 15629 - RNA, 17 nt, Artificial Sequence
  Synthetic
uggcuuuaggcuguuuu

SEQ ID NO: 15630 - RNA, 20 nt, Artificial Sequence
  Synthetic
aacuauuuacagccauaaca

SEQ ID NO: 15631 - RNA, 20 nt, Artificial Sequence
  Synthetic
aaaauacuuacuguacugca

SEQ ID NO: 15632 - RNA, 20 nt, Artificial Sequence
  Synthetic
auucacuggaaacccuguua

SEQ ID NO: 15633 - RNA, 20 nt, Artificial Sequence
  Synthetic
aaacuauuuacagccauaac

SEQ ID NO: 15634 - RNA, 20 nt, Artificial Sequence
  Synthetic
aaauacuuacuguacugcag

SEQ ID NO: 15635 - RNA, 20 nt, Artificial Sequence
  Synthetic
uacuguacugcaggggaauu

SEQ ID NO: 15636 - RNA, 20 nt, Artificial Sequence
  Synthetic
uuaggcuguuuuuggaucuu

SEQ ID NO: 15637 - RNA, 20 nt, Artificial Sequence
  Synthetic
caguggcuuuaggcuguuuu

SEQ ID NO: 15638 - RNA, 17 nt, Artificial Sequence
  Synthetic
gaauguagagaggcaga

SEQ ID NO: 15639 - RNA, 17 nt, Artificial Sequence
  Synthetic
ggaauguagagaggcag

SEQ ID NO: 15640 - RNA, 17 nt, Artificial Sequence
  Synthetic
guauuuucuuucauugg

SEQ ID NO: 15641 - RNA, 20 nt, Artificial Sequence
  Synthetic
guaaguauuuucuuucauug

SEQ ID NO: 15642 - RNA, 17 nt, Artificial Sequence
  Synthetic
aaaauaauuagaauaaa

SEQ ID NO: 15643 - RNA, 17 nt, Artificial Sequence
  Synthetic
cacauaaaaauuuaaga

SEQ ID NO: 15644 - RNA, 17 nt, Artificial Sequence
  Synthetic
acauaaaaauuuaagac

SEQ ID NO: 15645 - RNA, 17 nt, Artificial Sequence
  Synthetic
uguaaggcugggcgcag

SEQ ID NO: 15646 - RNA, 17 nt, Artificial Sequence
  Synthetic
aauguagagaggcagag

SEQ ID NO: 15647 - RNA, 17 nt, Artificial Sequence
  Synthetic
agaauaaaaggcuguuu

SEQ ID NO: 15648 - RNA, 20 nt, Artificial Sequence
  Synthetic
aguaaaauaauuagaauaaa

SEQ ID NO: 15649 - RNA, 20 nt, Artificial Sequence
  Synthetic
uuaagaaagcaguguaaggc

SEQ ID NO: 15650 - RNA, 20 nt, Artificial Sequence
  Synthetic
caguguaaggcugggcgcag

SEQ ID NO: 15651 - RNA, 20 nt, Artificial Sequence
  Synthetic
uuuggaauguagagaggcag

SEQ ID NO: 15652 - RNA, 20 nt, Artificial Sequence
  Synthetic
uggaauguagagaggcagag

SEQ ID NO: 15653 - RNA, 17 nt, Artificial Sequence
  Synthetic
aguauuuucuuucauug

SEQ ID NO: 15654 - RNA, 17 nt, Artificial Sequence
  Synthetic
uaaguauuuucuuucau

SEQ ID NO: 15655 - RNA, 17 nt, Artificial Sequence
  Synthetic
aaguauuuucuuucauu

SEQ ID NO: 15656 - RNA, 20 nt, Artificial Sequence
  Synthetic
uaaguauuuucuuucauugg

SEQ ID NO: 15657 - RNA, 20 nt, Artificial Sequence
  Synthetic
caguaaguauuuucuuucau

SEQ ID NO: 15658 - RNA, 20 nt, Artificial Sequence
  Synthetic
aguaaguauuuucuuucauu

SEQ ID NO: 15659 - RNA, 18 nt, Artificial Sequence
  Synthetic
ggggcugauauaacuucu

SEQ ID NO: 15660 - RNA, 20 nt, Artificial Sequence
  Synthetic
gaggggcugauauaacuucu

SEQ ID NO: 15661 - RNA, 23 nt, Artificial Sequence
  Synthetic
gcagaggggcugauauaacuucu

SEQ ID NO: 15662 - RNA, 24 nt, Artificial Sequence
  Synthetic
ggcagaggggcugauauaacuucu

SEQ ID NO: 15663 - RNA, 21 nt, Artificial Sequence
  Synthetic
gcaaacuauuuacagccauaa

SEQ ID NO: 15664 - RNA, 24 nt, Artificial Sequence
  Synthetic
gaagcaaacuauuuacagccauaa

SEQ ID NO: 15665 - RNA, 18 nt, Artificial Sequence
  Synthetic
gccauaacaggguuucca

SEQ ID NO: 15666 - RNA, 19 nt, Artificial Sequence
  Synthetic
gugaauuguauaaguagca

SEQ ID NO: 15667 - RNA, 19 nt, Artificial Sequence
  Synthetic
gcaaaacuagaaaguuuua

SEQ ID NO: 15668 - RNA, 20 nt, Artificial Sequence
  Synthetic
gcaguggcuuuaggcuguuu

SEQ ID NO: 15669 - RNA, 23 nt, Artificial Sequence
  Synthetic
guagcaguggcuuuaggcuguuu

SEQ ID NO: 15670 - RNA, 24 nt, Artificial Sequence
  Synthetic
gguagcaguggcuuuaggcuguuu

SEQ ID NO: 15671 - RNA, 21 nt, Artificial Sequence
  Synthetic
uuuauucuaauuauuuuacua

SEQ ID NO: 15672 - RNA, 22 nt, Artificial Sequence
  Synthetic
uuuuauucuaauuauuuuacua

SEQ ID NO: 15673 - RNA, 23 nt, Artificial Sequence
  Synthetic
cuuuuauucuaauuauuuuacua

SEQ ID NO: 15674 - RNA, 24 nt, Artificial Sequence
  Synthetic
ccuuuuauucuaauuauuuuacua

SEQ ID NO: 15675 - RNA, 18 nt, Artificial Sequence
  Synthetic
uauuuuacuagugaauua

SEQ ID NO: 15676 - RNA, 19 nt, Artificial Sequence
  Synthetic
uuauuuuacuagugaauua

SEQ ID NO: 15677 - RNA, 20 nt, Artificial Sequence
  Synthetic
auuauuuuacuagugaauua

SEQ ID NO: 15678 - RNA, 21 nt, Artificial Sequence
  Synthetic
aauuauuuuacuagugaauua

SEQ ID NO: 15679 - RNA, 22 nt, Artificial Sequence
  Synthetic
uaauuauuuuacuagugaauua

SEQ ID NO: 15680 - RNA, 23 nt, Artificial Sequence
  Synthetic
cuaauuauuuuacuagugaauua

SEQ ID NO: 15681 - RNA, 24 nt, Artificial Sequence
  Synthetic
ucuaauuauuuuacuagugaauua

SEQ ID NO: 15682 - RNA, 18 nt, Artificial Sequence
  Synthetic
auucacuaguaaaauaau

SEQ ID NO: 15683 - RNA, 19 nt, Artificial Sequence
  Synthetic
aauucacuaguaaaauaau

SEQ ID NO: 15684 - RNA, 20 nt, Artificial Sequence
  Synthetic
uaauucacuaguaaaauaau

SEQ ID NO: 15685 - RNA, 19 nt, Artificial Sequence
  Synthetic
aggggcugauauaacuucu

SEQ ID NO: 15686 - RNA, 21 nt, Artificial Sequence
  Synthetic
agaggggcugauauaacuucu

SEQ ID NO: 15687 - RNA, 22 nt, Artificial Sequence
  Synthetic
cagaggggcugauauaacuucu

SEQ ID NO: 15688 - RNA, 18 nt, Artificial Sequence
  Synthetic
uagaauaaaaggcuguuu

SEQ ID NO: 15689 - RNA, 19 nt, Artificial Sequence
  Synthetic
uuagaauaaaaggcuguuu

SEQ ID NO: 15690 - RNA, 20 nt, Artificial Sequence
  Synthetic
auuagaauaaaaggcuguuu

SEQ ID NO: 15691 - RNA, 21 nt, Artificial Sequence
  Synthetic
aauuagaauaaaaggcuguuu

SEQ ID NO: 15692 - RNA, 22 nt, Artificial Sequence
  Synthetic
uaauuagaauaaaaggcuguuu

SEQ ID NO: 15693 - RNA, 23 nt, Artificial Sequence
  Synthetic
auaauuagaauaaaaggcuguuu

SEQ ID NO: 15694 - RNA, 24 nt, Artificial Sequence
  Synthetic
aauaauuagaauaaaaggcuguuu

SEQ ID NO: 15695 - RNA, 18 nt, Artificial Sequence
  Synthetic
auacuuacuguacugcag

SEQ ID NO: 15696 - RNA, 19 nt, Artificial Sequence
  Synthetic
aauacuuacuguacugcag

SEQ ID NO: 15697 - RNA, 20 nt, Artificial Sequence
  Synthetic
aaauacuuacuguacugcag

SEQ ID NO: 15698 - RNA, 18 nt, Artificial Sequence
  Synthetic
aacuauuuacagccauaa

SEQ ID NO: 15699 - RNA, 19 nt, Artificial Sequence
  Synthetic
aaacuauuuacagccauaa

SEQ ID NO: 15700 - RNA, 20 nt, Artificial Sequence
  Synthetic
caaacuauuuacagccauaa

SEQ ID NO: 15701 - RNA, 22 nt, Artificial Sequence
  Synthetic
agcaaacuauuuacagccauaa

SEQ ID NO: 15702 - RNA, 23 nt, Artificial Sequence
  Synthetic
aagcaaacuauuuacagccauaa

SEQ ID NO: 15703 - RNA, 19 nt, Artificial Sequence
  Synthetic
agccauaacaggguuucca

SEQ ID NO: 15704 - RNA, 20 nt, Artificial Sequence
  Synthetic
cagccauaacaggguuucca

SEQ ID NO: 15705 - RNA, 21 nt, Artificial Sequence
  Synthetic
acagccauaacaggguuucca

SEQ ID NO: 15706 - RNA, 22 nt, Artificial Sequence
  Synthetic
uacagccauaacaggguuucca

SEQ ID NO: 15707 - RNA, 23 nt, Artificial Sequence
  Synthetic
uuacagccauaacaggguuucca

SEQ ID NO: 15708 - RNA, 24 nt, Artificial Sequence
  Synthetic
uuuacagccauaacaggguuucca

SEQ ID NO: 15709 - RNA, 18 nt, Artificial Sequence
  Synthetic
ugaauuguauaaguagca

SEQ ID NO: 15710 - RNA, 20 nt, Artificial Sequence
  Synthetic
agugaauuguauaaguagca

SEQ ID NO: 15711 - RNA, 21 nt, Artificial Sequence
  Synthetic
cagugaauuguauaaguagca

SEQ ID NO: 15712 - RNA, 22 nt, Artificial Sequence
  Synthetic
ccagugaauuguauaaguagca

SEQ ID NO: 15713 - RNA, 23 nt, Artificial Sequence
  Synthetic
uccagugaauuguauaaguagca

SEQ ID NO: 15714 - RNA, 24 nt, Artificial Sequence
  Synthetic
uuccagugaauuguauaaguagca

SEQ ID NO: 15715 - RNA, 18 nt, Artificial Sequence
  Synthetic
caaaacuagaaaguuuua

SEQ ID NO: 15716 - RNA, 20 nt, Artificial Sequence
  Synthetic
agcaaaacuagaaaguuuua

SEQ ID NO: 15717 - RNA, 18 nt, Artificial Sequence
  Synthetic
aguggcuuuaggcuguuu

SEQ ID NO: 15718 - RNA, 19 nt, Artificial Sequence
  Synthetic
caguggcuuuaggcuguuu

SEQ ID NO: 15719 - RNA, 21 nt, Artificial Sequence
  Synthetic
agcaguggcuuuaggcuguuu

SEQ ID NO: 15720 - RNA, 22 nt, Artificial Sequence
  Synthetic
uagcaguggcuuuaggcuguuu

SEQ ID NO: 15721 - RNA, 22 nt, Artificial Sequence
  Synthetic
gaaaauacuuacuguacugcag

SEQ ID NO: 15722 - RNA, 24 nt, Artificial Sequence
  Synthetic
guuaagcaaaacuagaaaguuuua

SEQ ID NO: 15723 - RNA, 18 nt, Artificial Sequence
  Synthetic
auucuaauuauuuuacua

SEQ ID NO: 15724 - RNA, 19 nt, Artificial Sequence
  Synthetic
uauucuaauuauuuuacua

SEQ ID NO: 15725 - RNA, 20 nt, Artificial Sequence
  Synthetic
uuauucuaauuauuuuacua

SEQ ID NO: 15726 - RNA, 21 nt, Artificial Sequence
  Synthetic
auaauucacuaguaaaauaau

SEQ ID NO: 15727 - RNA, 22 nt, Artificial Sequence
  Synthetic
cauaauucacuaguaaaauaau

SEQ ID NO: 15728 - RNA, 23 nt, Artificial Sequence
  Synthetic
ccauaauucacuaguaaaauaau

SEQ ID NO: 15729 - RNA, 24 nt, Artificial Sequence
  Synthetic
uccauaauucacuaguaaaauaau

SEQ ID NO: 15730 - RNA, 21 nt, Artificial Sequence
  Synthetic
aaaauacuuacuguacugcag

SEQ ID NO: 15731 - RNA, 23 nt, Artificial Sequence
  Synthetic
agaaaauacuuacuguacugcag

SEQ ID NO: 15732 - RNA, 24 nt, Artificial Sequence
  Synthetic
aagaaaauacuuacuguacugcag

SEQ ID NO: 15733 - RNA, 21 nt, Artificial Sequence
  Synthetic
aagcaaaacuagaaaguuuua

SEQ ID NO: 15734 - RNA, 22 nt, Artificial Sequence
  Synthetic
uaagcaaaacuagaaaguuuua

SEQ ID NO: 15735 - RNA, 23 nt, Artificial Sequence
  Synthetic
uuaagcaaaacuagaaaguuuua

SEQ ID NO: 15736 - RNA, 18 nt, Artificial Sequence
  Synthetic
aaauuuaagacgggaaaa

SEQ ID NO: 15737 - RNA, 19 nt, Artificial Sequence
  Synthetic
aaaauuuaagacgggaaaa

SEQ ID NO: 15738 - RNA, 20 nt, Artificial Sequence
  Synthetic
aaaaauuuaagacgggaaaa

SEQ ID NO: 15739 - RNA, 21 nt, Artificial Sequence
  Synthetic
uaaaaauuuaagacgggaaaa

SEQ ID NO: 15740 - RNA, 22 nt, Artificial Sequence
  Synthetic
auaaaaauuuaagacgggaaaa

SEQ ID NO: 15741 - RNA, 23 nt, Artificial Sequence
  Synthetic
cauaaaaauuuaagacgggaaaa

SEQ ID NO: 15742 - RNA, 24 nt, Artificial Sequence
  Synthetic
acauaaaaauuuaagacgggaaaa

SEQ ID NO: 15743 - RNA, 18 nt, Artificial Sequence
  Synthetic
ucacauaaaaauuuaaga

SEQ ID NO: 15744 - RNA, 19 nt, Artificial Sequence
  Synthetic
cucacauaaaaauuuaaga

SEQ ID NO: 15745 - RNA, 20 nt, Artificial Sequence
  Synthetic
ucucacauaaaaauuuaaga

SEQ ID NO: 15746 - RNA, 21 nt, Artificial Sequence
  Synthetic
aucucacauaaaaauuuaaga

SEQ ID NO: 15747 - RNA, 22 nt, Artificial Sequence
  Synthetic
caucucacauaaaaauuuaaga

SEQ ID NO: 15748 - RNA, 23 nt, Artificial Sequence
  Synthetic
ucaucucacauaaaaauuuaaga

SEQ ID NO: 15749 - RNA, 24 nt, Artificial Sequence
  Synthetic
cucaucucacauaaaaauuuaaga

SEQ ID NO: 15750 - RNA, 18 nt, Artificial Sequence
  Synthetic
aauuuaagacgggaaaac

SEQ ID NO: 15751 - RNA, 19 nt, Artificial Sequence
  Synthetic
aaauuuaagacgggaaaac

SEQ ID NO: 15752 - RNA, 20 nt, Artificial Sequence
  Synthetic
aaaauuuaagacgggaaaac

SEQ ID NO: 15753 - RNA, 21 nt, Artificial Sequence
  Synthetic
aaaaauuuaagacgggaaaac

SEQ ID NO: 15754 - RNA, 22 nt, Artificial Sequence
  Synthetic
uaaaaauuuaagacgggaaaac

SEQ ID NO: 15755 - RNA, 23 nt, Artificial Sequence
  Synthetic
auaaaaauuuaagacgggaaaac

SEQ ID NO: 15756 - RNA, 24 nt, Artificial Sequence
  Synthetic
cauaaaaauuuaagacgggaaaac

SEQ ID NO: 15757 - RNA, 18 nt, Artificial Sequence
  Synthetic
cacauaaaaauuuaagac

SEQ ID NO: 15758 - RNA, 19 nt, Artificial Sequence
  Synthetic
ucacauaaaaauuuaagac

SEQ ID NO: 15759 - RNA, 20 nt, Artificial Sequence
  Synthetic
cucacauaaaaauuuaagac

SEQ ID NO: 15760 - RNA, 21 nt, Artificial Sequence
  Synthetic
ucucacauaaaaauuuaagac

SEQ ID NO: 15761 - RNA, 22 nt, Artificial Sequence
  Synthetic
aucucacauaaaaauuuaagac

SEQ ID NO: 15762 - RNA, 23 nt, Artificial Sequence
  Synthetic
caucucacauaaaaauuuaagac

SEQ ID NO: 15763 - RNA, 24 nt, Artificial Sequence
  Synthetic
ucaucucacauaaaaauuuaagac

SEQ ID NO: 15764 - RNA, 18 nt, Artificial Sequence
  Synthetic
cucacauaaaaauuuaag

SEQ ID NO: 15765 - RNA, 19 nt, Artificial Sequence
  Synthetic
ucucacauaaaaauuuaag

SEQ ID NO: 15766 - RNA, 20 nt, Artificial Sequence
  Synthetic
aucucacauaaaaauuuaag

SEQ ID NO: 15767 - RNA, 21 nt, Artificial Sequence
  Synthetic
caucucacauaaaaauuuaag

SEQ ID NO: 15768 - RNA, 22 nt, Artificial Sequence
  Synthetic
ucaucucacauaaaaauuuaag

SEQ ID NO: 15769 - RNA, 23 nt, Artificial Sequence
  Synthetic
cucaucucacauaaaaauuuaag

SEQ ID NO: 15770 - RNA, 24 nt, Artificial Sequence
  Synthetic
gcucaucucacauaaaaauuuaag

SEQ ID NO: 15771 - RNA, 18 nt, Artificial Sequence
  Synthetic
caacuuguguugcacuag

SEQ ID NO: 15772 - RNA, 19 nt, Artificial Sequence
  Synthetic
acaacuuguguugcacuag

SEQ ID NO: 15773 - RNA, 20 nt, Artificial Sequence
  Synthetic
cacaacuuguguugcacuag

SEQ ID NO: 15774 - RNA, 21 nt, Artificial Sequence
  Synthetic
acacaacuuguguugcacuag

SEQ ID NO: 15775 - RNA, 22 nt, Artificial Sequence
  Synthetic
uacacaacuuguguugcacuag

SEQ ID NO: 15776 - RNA, 23 nt, Artificial Sequence
  Synthetic
cuacacaacuuguguugcacuag

SEQ ID NO: 15777 - RNA, 24 nt, Artificial Sequence
  Synthetic
ucuacacaacuuguguugcacuag

SEQ ID NO: 15778 - RNA, 18 nt, Artificial Sequence
  Synthetic
aacaggaagaugcauucu

SEQ ID NO: 15779 - RNA, 19 nt, Artificial Sequence
  Synthetic
aaacaggaagaugcauucu

SEQ ID NO: 15780 - RNA, 20 nt, Artificial Sequence
  Synthetic
aaaacaggaagaugcauucu

SEQ ID NO: 15781 - RNA, 21 nt, Artificial Sequence
  Synthetic
gaaaacaggaagaugcauucu

SEQ ID NO: 15782 - RNA, 22 nt, Artificial Sequence
  Synthetic
ggaaaacaggaagaugcauucu

SEQ ID NO: 15783 - RNA, 23 nt, Artificial Sequence
  Synthetic
gggaaaacaggaagaugcauucu

SEQ ID NO: 15784 - RNA, 24 nt, Artificial Sequence
  Synthetic
cgggaaaacaggaagaugcauucu

SEQ ID NO: 15785 - RNA, 18 nt, Artificial Sequence
  Synthetic
uuauuuuacuagugaauu

SEQ ID NO: 15786 - RNA, 19 nt, Artificial Sequence
  Synthetic
auuauuuuacuagugaauu

SEQ ID NO: 15787 - RNA, 20 nt, Artificial Sequence
  Synthetic
aauuauuuuacuagugaauu

SEQ ID NO: 15788 - RNA, 21 nt, Artificial Sequence
  Synthetic
uaauuauuuuacuagugaauu

SEQ ID NO: 15789 - RNA, 22 nt, Artificial Sequence
  Synthetic
cuaauuauuuuacuagugaauu

SEQ ID NO: 15790 - RNA, 23 nt, Artificial Sequence
  Synthetic
ucuaauuauuuuacuagugaauu

SEQ ID NO: 15791 - RNA, 24 nt, Artificial Sequence
  Synthetic
uucuaauuauuuuacuagugaauu

SEQ ID NO: 15792 - RNA, 18 nt, Artificial Sequence
  Synthetic
aaaacaggaagaugcauu

SEQ ID NO: 15793 - RNA, 19 nt, Artificial Sequence
  Synthetic
gaaaacaggaagaugcauu

SEQ ID NO: 15794 - RNA, 20 nt, Artificial Sequence
  Synthetic
ggaaaacaggaagaugcauu

SEQ ID NO: 15795 - RNA, 21 nt, Artificial Sequence
  Synthetic
gggaaaacaggaagaugcauu

SEQ ID NO: 15796 - RNA, 22 nt, Artificial Sequence
  Synthetic
cgggaaaacaggaagaugcauu

SEQ ID NO: 15797 - RNA, 23 nt, Artificial Sequence
  Synthetic
acgggaaaacaggaagaugcauu

SEQ ID NO: 15798 - RNA, 24 nt, Artificial Sequence
  Synthetic
gacgggaaaacaggaagaugcauu

SEQ ID NO: 15799 - RNA, 18 nt, Artificial Sequence
  Synthetic
uuggaauguagagaggca

SEQ ID NO: 15800 - RNA, 19 nt, Artificial Sequence
  Synthetic
uuuggaauguagagaggca

SEQ ID NO: 15801 - RNA, 20 nt, Artificial Sequence
  Synthetic
uuuuggaauguagagaggca

SEQ ID NO: 15802 - RNA, 21 nt, Artificial Sequence
  Synthetic
guuuuggaauguagagaggca

SEQ ID NO: 15803 - RNA, 22 nt, Artificial Sequence
  Synthetic
uguuuuggaauguagagaggca

SEQ ID NO: 15804 - RNA, 23 nt, Artificial Sequence
  Synthetic
cuguuuuggaauguagagaggca

SEQ ID NO: 15805 - RNA, 24 nt, Artificial Sequence
  Synthetic
gcuguuuuggaauguagagaggca

SEQ ID NO: 15806 - RNA, 18 nt, Artificial Sequence
  Synthetic
caacacaaguuguguaga

SEQ ID NO: 15807 - RNA, 19 nt, Artificial Sequence
  Synthetic
gcaacacaaguuguguaga

SEQ ID NO: 15808 - RNA, 20 nt, Artificial Sequence
  Synthetic
ugcaacacaaguuguguaga

SEQ ID NO: 15809 - RNA, 21 nt, Artificial Sequence
  Synthetic
gugcaacacaaguuguguaga

SEQ ID NO: 15810 - RNA, 22 nt, Artificial Sequence
  Synthetic
agugcaacacaaguuguguaga

SEQ ID NO: 15811 - RNA, 23 nt, Artificial Sequence
  Synthetic
uagugcaacacaaguuguguaga

SEQ ID NO: 15812 - RNA, 24 nt, Artificial Sequence
  Synthetic
cuagugcaacacaaguuguguaga

SEQ ID NO: 15813 - RNA, 18 nt, Artificial Sequence
  Synthetic
aggcuguuuuggaaugua

SEQ ID NO: 15814 - RNA, 19 nt, Artificial Sequence
  Synthetic
aaggcuguuuuggaaugua

SEQ ID NO: 15815 - RNA, 20 nt, Artificial Sequence
  Synthetic
aaaggcuguuuuggaaugua

SEQ ID NO: 15816 - RNA, 21 nt, Artificial Sequence
  Synthetic
aaaaggcuguuuuggaaugua

SEQ ID NO: 15817 - RNA, 22 nt, Artificial Sequence
  Synthetic
uaaaaggcuguuuuggaaugua

SEQ ID NO: 15818 - RNA, 23 nt, Artificial Sequence
  Synthetic
auaaaaggcuguuuuggaaugua

SEQ ID NO: 15819 - RNA, 24 nt, Artificial Sequence
  Synthetic
aauaaaaggcuguuuuggaaugua

SEQ ID NO: 15820 - RNA, 18 nt, Artificial Sequence
  Synthetic
uggaauguagagaggcag

SEQ ID NO: 15821 - RNA, 19 nt, Artificial Sequence
  Synthetic
uuggaauguagagaggcag

SEQ ID NO: 15822 - RNA, 20 nt, Artificial Sequence
  Synthetic
uuuggaauguagagaggcag

SEQ ID NO: 15823 - RNA, 21 nt, Artificial Sequence
  Synthetic
uuuuggaauguagagaggcag

SEQ ID NO: 15824 - RNA, 22 nt, Artificial Sequence
  Synthetic
guuuuggaauguagagaggcag

SEQ ID NO: 15825 - RNA, 23 nt, Artificial Sequence
  Synthetic
uguuuuggaauguagagaggcag

SEQ ID NO: 15826 - RNA, 24 nt, Artificial Sequence
  Synthetic
cuguuuuggaauguagagaggcag

SEQ ID NO: 15827 - RNA, 18 nt, Artificial Sequence
  Synthetic
cuuaaauuuuuaugugag

SEQ ID NO: 15828 - RNA, 19 nt, Artificial Sequence
  Synthetic
ucuuaaauuuuuaugugag

SEQ ID NO: 15829 - RNA, 20 nt, Artificial Sequence
  Synthetic
gucuuaaauuuuuaugugag

SEQ ID NO: 15830 - RNA, 21 nt, Artificial Sequence
  Synthetic
cgucuuaaauuuuuaugugag

SEQ ID NO: 15831 - RNA, 22 nt, Artificial Sequence
  Synthetic
ccgucuuaaauuuuuaugugag

SEQ ID NO: 15832 - RNA, 23 nt, Artificial Sequence
  Synthetic
cccgucuuaaauuuuuaugugag

SEQ ID NO: 15833 - RNA, 24 nt, Artificial Sequence
  Synthetic
ucccgucuuaaauuuuuaugugag

SEQ ID NO: 15834 - RNA, 18 nt, Artificial Sequence
  Synthetic
uaagaaagcaguguaagg

SEQ ID NO: 15835 - RNA, 19 nt, Artificial Sequence
  Synthetic
uuaagaaagcaguguaagg

SEQ ID NO: 15836 - RNA, 20 nt, Artificial Sequence
  Synthetic
auuaagaaagcaguguaagg

SEQ ID NO: 15837 - RNA, 21 nt, Artificial Sequence
  Synthetic
aauuaagaaagcaguguaagg

SEQ ID NO: 15838 - RNA, 22 nt, Artificial Sequence
  Synthetic
uaauuaagaaagcaguguaagg

SEQ ID NO: 15839 - RNA, 23 nt, Artificial Sequence
  Synthetic
guaauuaagaaagcaguguaagg

SEQ ID NO: 15840 - RNA, 24 nt, Artificial Sequence
  Synthetic
uguaauuaagaaagcaguguaagg

SEQ ID NO: 15841 - RNA, 18 nt, Artificial Sequence
  Synthetic
uuuuggaauguagagagg

SEQ ID NO: 15842 - RNA, 19 nt, Artificial Sequence
  Synthetic
guuuuggaauguagagagg

SEQ ID NO: 15843 - RNA, 20 nt, Artificial Sequence
  Synthetic
uguuuuggaauguagagagg

SEQ ID NO: 15844 - RNA, 21 nt, Artificial Sequence
  Synthetic
cuguuuuggaauguagagagg

SEQ ID NO: 15845 - RNA, 22 nt, Artificial Sequence
  Synthetic
gcuguuuuggaauguagagagg

SEQ ID NO: 15846 - RNA, 23 nt, Artificial Sequence
  Synthetic
ggcuguuuuggaauguagagagg

SEQ ID NO: 15847 - RNA, 24 nt, Artificial Sequence
  Synthetic
aggcuguuuuggaauguagagagg

SEQ ID NO: 15848 - RNA, 18 nt, Artificial Sequence
  Synthetic
aaaggcuguuuuggaaug

SEQ ID NO: 15849 - RNA, 19 nt, Artificial Sequence
  Synthetic
aaaaggcuguuuuggaaug

SEQ ID NO: 15850 - RNA, 20 nt, Artificial Sequence
  Synthetic
uaaaaggcuguuuuggaaug

SEQ ID NO: 15851 - RNA, 21 nt, Artificial Sequence
  Synthetic
auaaaaggcuguuuuggaaug

SEQ ID NO: 15852 - RNA, 22 nt, Artificial Sequence
  Synthetic
aauaaaaggcuguuuuggaaug

SEQ ID NO: 15853 - RNA, 23 nt, Artificial Sequence
  Synthetic
gaauaaaaggcuguuuuggaaug

SEQ ID NO: 15854 - RNA, 24 nt, Artificial Sequence
  Synthetic
agaauaaaaggcuguuuuggaaug

SEQ ID NO: 15855 - RNA, 18 nt, Artificial Sequence
  Synthetic
agugcaacacaaguugug

SEQ ID NO: 15856 - RNA, 19 nt, Artificial Sequence
  Synthetic
uagugcaacacaaguugug

SEQ ID NO: 15857 - RNA, 20 nt, Artificial Sequence
  Synthetic
cuagugcaacacaaguugug

SEQ ID NO: 15858 - RNA, 21 nt, Artificial Sequence
  Synthetic
ccuagugcaacacaaguugug

SEQ ID NO: 15859 - RNA, 22 nt, Artificial Sequence
  Synthetic
accuagugcaacacaaguugug

SEQ ID NO: 15860 - RNA, 23 nt, Artificial Sequence
  Synthetic
caccuagugcaacacaaguugug

SEQ ID NO: 15861 - RNA, 24 nt, Artificial Sequence
  Synthetic
ucaccuagugcaacacaaguugug

SEQ ID NO: 15862 - RNA, 18 nt, Artificial Sequence
  Synthetic
cccgucuuaaauuuuuau

SEQ ID NO: 15863 - RNA, 19 nt, Artificial Sequence
  Synthetic
ucccgucuuaaauuuuuau

SEQ ID NO: 15864 - RNA, 20 nt, Artificial Sequence
  Synthetic
uucccgucuuaaauuuuuau

SEQ ID NO: 15865 - RNA, 21 nt, Artificial Sequence
  Synthetic
uuucccgucuuaaauuuuuau

SEQ ID NO: 15866 - RNA, 22 nt, Artificial Sequence
  Synthetic
uuuucccgucuuaaauuuuuau

SEQ ID NO: 15867 - RNA, 23 nt, Artificial Sequence
  Synthetic
guuuucccgucuuaaauuuuuau

SEQ ID NO: 15868 - RNA, 24 nt, Artificial Sequence
  Synthetic
uguuuucccgucuuaaauuuuuau

SEQ ID NO: 15869 - RNA, 18 nt, Artificial Sequence
  Synthetic
gagcacacugcuguaauu

SEQ ID NO: 15870 - RNA, 19 nt, Artificial Sequence
  Synthetic
ugagcacacugcuguaauu

SEQ ID NO: 15871 - RNA, 20 nt, Artificial Sequence
  Synthetic
augagcacacugcuguaauu

SEQ ID NO: 15872 - RNA, 21 nt, Artificial Sequence
  Synthetic
gaugagcacacugcuguaauu

SEQ ID NO: 15873 - RNA, 22 nt, Artificial Sequence
  Synthetic
agaugagcacacugcuguaauu

SEQ ID NO: 15874 - RNA, 23 nt, Artificial Sequence
  Synthetic
gagaugagcacacugcuguaauu

SEQ ID NO: 15875 - RNA, 24 nt, Artificial Sequence
  Synthetic
ugagaugagcacacugcuguaauu

SEQ ID NO: 15876 - RNA, 18 nt, Artificial Sequence
  Synthetic
uuagaauaaaaggcuguu

SEQ ID NO: 15877 - RNA, 19 nt, Artificial Sequence
  Synthetic
auuagaauaaaaggcuguu

SEQ ID NO: 15878 - RNA, 20 nt, Artificial Sequence
  Synthetic
aauuagaauaaaaggcuguu

SEQ ID NO: 15879 - RNA, 21 nt, Artificial Sequence
  Synthetic
uaauuagaauaaaaggcuguu

SEQ ID NO: 15880 - RNA, 22 nt, Artificial Sequence
  Synthetic
auaauuagaauaaaaggcuguu

SEQ ID NO: 15881 - RNA, 23 nt, Artificial Sequence
  Synthetic
aauaauuagaauaaaaggcuguu

SEQ ID NO: 15882 - RNA, 24 nt, Artificial Sequence
  Synthetic
aaauaauuagaauaaaaggcuguu

SEQ ID NO: 15883 - RNA, 18 nt, Artificial Sequence
  Synthetic
uuucauuuuuugcugaca

SEQ ID NO: 15884 - RNA, 19 nt, Artificial Sequence
  Synthetic
guuucauuuuuugcugaca

SEQ ID NO: 15885 - RNA, 20 nt, Artificial Sequence
  Synthetic
uguuucauuuuuugcugaca

SEQ ID NO: 15886 - RNA, 21 nt, Artificial Sequence
  Synthetic
uuguuucauuuuuugcugaca

SEQ ID NO: 15887 - RNA, 22 nt, Artificial Sequence
  Synthetic
uuuguuucauuuuuugcugaca

SEQ ID NO: 15888 - RNA, 23 nt, Artificial Sequence
  Synthetic
uuuuguuucauuuuuugcugaca

SEQ ID NO: 15889 - RNA, 24 nt, Artificial Sequence
  Synthetic
uuuuuguuucauuuuuugcugaca

SEQ ID NO: 15890 - RNA, 18 nt, Artificial Sequence
  Synthetic
aauaguuugcuuccccca

SEQ ID NO: 15891 - RNA, 19 nt, Artificial Sequence
  Synthetic
aaauaguuugcuuccccca

SEQ ID NO: 15892 - RNA, 20 nt, Artificial Sequence
  Synthetic
uaaauaguuugcuuccccca

SEQ ID NO: 15893 - RNA, 21 nt, Artificial Sequence
  Synthetic
guaaauaguuugcuuccccca

SEQ ID NO: 15894 - RNA, 22 nt, Artificial Sequence
  Synthetic
uguaaauaguuugcuuccccca

SEQ ID NO: 15895 - RNA, 23 nt, Artificial Sequence
  Synthetic
cuguaaauaguuugcuuccccca

SEQ ID NO: 15896 - RNA, 24 nt, Artificial Sequence
  Synthetic
gcuguaaauaguuugcuuccccca

SEQ ID NO: 15897 - RNA, 18 nt, Artificial Sequence
  Synthetic
aauacuuacuguacugca

SEQ ID NO: 15898 - RNA, 19 nt, Artificial Sequence
  Synthetic
aaauacuuacuguacugca

SEQ ID NO: 15899 - RNA, 20 nt, Artificial Sequence
  Synthetic
aaaauacuuacuguacugca

SEQ ID NO: 15900 - RNA, 21 nt, Artificial Sequence
  Synthetic
gaaaauacuuacuguacugca

SEQ ID NO: 15901 - RNA, 22 nt, Artificial Sequence
  Synthetic
agaaaauacuuacuguacugca

SEQ ID NO: 15902 - RNA, 23 nt, Artificial Sequence
  Synthetic
aagaaaauacuuacuguacugca

SEQ ID NO: 15903 - RNA, 24 nt, Artificial Sequence
  Synthetic
aaagaaaauacuuacuguacugca

SEQ ID NO: 15904 - RNA, 18 nt, Artificial Sequence
  Synthetic
ugcuacuuauacaauuca

SEQ ID NO: 15905 - RNA, 19 nt, Artificial Sequence
  Synthetic
gugcuacuuauacaauuca

SEQ ID NO: 15906 - RNA, 20 nt, Artificial Sequence
  Synthetic
agugcuacuuauacaauuca

SEQ ID NO: 15907 - RNA, 21 nt, Artificial Sequence
  Synthetic
cagugcuacuuauacaauuca

SEQ ID NO: 15908 - RNA, 22 nt, Artificial Sequence
  Synthetic
ucagugcuacuuauacaauuca

SEQ ID NO: 15909 - RNA, 23 nt, Artificial Sequence
  Synthetic
cucagugcuacuuauacaauuca

SEQ ID NO: 15910 - RNA, 24 nt, Artificial Sequence
  Synthetic
acucagugcuacuuauacaauuca

SEQ ID NO: 15911 - RNA, 18 nt, Artificial Sequence
  Synthetic
guuugcuucccccaauga

SEQ ID NO: 15912 - RNA, 19 nt, Artificial Sequence
  Synthetic
aguuugcuucccccaauga

SEQ ID NO: 15913 - RNA, 20 nt, Artificial Sequence
  Synthetic
uaguuugcuucccccaauga

SEQ ID NO: 15914 - RNA, 21 nt, Artificial Sequence
  Synthetic
auaguuugcuucccccaauga

SEQ ID NO: 15915 - RNA, 22 nt, Artificial Sequence
  Synthetic
aauaguuugcuucccccaauga

SEQ ID NO: 15916 - RNA, 23 nt, Artificial Sequence
  Synthetic
aaauaguuugcuucccccaauga

SEQ ID NO: 15917 - RNA, 24 nt, Artificial Sequence
  Synthetic
uaaauaguuugcuucccccaauga

SEQ ID NO: 15918 - RNA, 18 nt, Artificial Sequence
  Synthetic
uuucuaguuuugcuuaac

SEQ ID NO: 15919 - RNA, 19 nt, Artificial Sequence
  Synthetic
cuuucuaguuuugcuuaac

SEQ ID NO: 15920 - RNA, 20 nt, Artificial Sequence
  Synthetic
acuuucuaguuuugcuuaac

SEQ ID NO: 15921 - RNA, 21 nt, Artificial Sequence
  Synthetic
aacuuucuaguuuugcuuaac

SEQ ID NO: 15922 - RNA, 22 nt, Artificial Sequence
  Synthetic
aaacuuucuaguuuugcuuaac

SEQ ID NO: 15923 - RNA, 23 nt, Artificial Sequence
  Synthetic
aaaacuuucuaguuuugcuuaac

SEQ ID NO: 15924 - RNA, 24 nt, Artificial Sequence
  Synthetic
uaaaacuuucuaguuuugcuuaac

SEQ ID NO: 15925 - RNA, 18 nt, Artificial Sequence
  Synthetic
gcuacuuauacaauucac

SEQ ID NO: 15926 - RNA, 19 nt, Artificial Sequence
  Synthetic
ugcuacuuauacaauucac

SEQ ID NO: 15927 - RNA, 20 nt, Artificial Sequence
  Synthetic
gugcuacuuauacaauucac

SEQ ID NO: 15928 - RNA, 21 nt, Artificial Sequence
  Synthetic
agugcuacuuauacaauucac

SEQ ID NO: 15929 - RNA, 22 nt, Artificial Sequence
  Synthetic
cagugcuacuuauacaauucac

SEQ ID NO: 15930 - RNA, 23 nt, Artificial Sequence
  Synthetic
ucagugcuacuuauacaauucac

SEQ ID NO: 15931 - RNA, 24 nt, Artificial Sequence
  Synthetic
cucagugcuacuuauacaauucac

SEQ ID NO: 15932 - RNA, 18 nt, Artificial Sequence
  Synthetic
aaauacuuacuguacugc

SEQ ID NO: 15933 - RNA, 19 nt, Artificial Sequence
  Synthetic
aaaauacuuacuguacugc

SEQ ID NO: 15934 - RNA, 20 nt, Artificial Sequence
  Synthetic
gaaaauacuuacuguacugc

SEQ ID NO: 15935 - RNA, 21 nt, Artificial Sequence
  Synthetic
agaaaauacuuacuguacugc

SEQ ID NO: 15936 - RNA, 22 nt, Artificial Sequence
  Synthetic
aagaaaauacuuacuguacugc

SEQ ID NO: 15937 - RNA, 23 nt, Artificial Sequence
  Synthetic
aaagaaaauacuuacuguacugc

SEQ ID NO: 15938 - RNA, 24 nt, Artificial Sequence
  Synthetic
gaaagaaaauacuuacuguacugc

SEQ ID NO: 15939 - RNA, 18 nt, Artificial Sequence
  Synthetic
aaaauacuuacuguacug

SEQ ID NO: 15940 - RNA, 19 nt, Artificial Sequence
  Synthetic
gaaaauacuuacuguacug

SEQ ID NO: 15941 - RNA, 20 nt, Artificial Sequence
  Synthetic
agaaaauacuuacuguacug

SEQ ID NO: 15942 - RNA, 21 nt, Artificial Sequence
  Synthetic
aagaaaauacuuacuguacug

SEQ ID NO: 15943 - RNA, 22 nt, Artificial Sequence
  Synthetic
aaagaaaauacuuacuguacug

SEQ ID NO: 15944 - RNA, 23 nt, Artificial Sequence
  Synthetic
gaaagaaaauacuuacuguacug

SEQ ID NO: 15945 - RNA, 24 nt, Artificial Sequence
  Synthetic
ugaaagaaaauacuuacuguacug

SEQ ID NO: 15946 - RNA, 18 nt, Artificial Sequence
  Synthetic
guucugugucagcaaaaa

SEQ ID NO: 15947 - RNA, 19 nt, Artificial Sequence
  Synthetic
aguucugugucagcaaaaa

SEQ ID NO: 15948 - RNA, 20 nt, Artificial Sequence
  Synthetic
gaguucugugucagcaaaaa

SEQ ID NO: 15949 - RNA, 21 nt, Artificial Sequence
  Synthetic
ugaguucugugucagcaaaaa

SEQ ID NO: 15950 - RNA, 22 nt, Artificial Sequence
  Synthetic
cugaguucugugucagcaaaaa

SEQ ID NO: 15951 - RNA, 23 nt, Artificial Sequence
  Synthetic
acugaguucugugucagcaaaaa

SEQ ID NO: 15952 - RNA, 24 nt, Artificial Sequence
  Synthetic
cacugaguucugugucagcaaaaa

SEQ ID NO: 15953 - RNA, 18 nt, Artificial Sequence
  Synthetic
aguaaguauuuucuuuca

SEQ ID NO: 15954 - RNA, 19 nt, Artificial Sequence
  Synthetic
caguaaguauuuucuuuca

SEQ ID NO: 15955 - RNA, 20 nt, Artificial Sequence
  Synthetic
acaguaaguauuuucuuuca

SEQ ID NO: 15956 - RNA, 21 nt, Artificial Sequence
  Synthetic
uacaguaaguauuuucuuuca

SEQ ID NO: 15957 - RNA, 22 nt, Artificial Sequence
  Synthetic
guacaguaaguauuuucuuuca

SEQ ID NO: 15958 - RNA, 23 nt, Artificial Sequence
  Synthetic
aguacaguaaguauuuucuuuca

SEQ ID NO: 15959 - RNA, 24 nt, Artificial Sequence
  Synthetic
caguacaguaaguauuuucuuuca

SEQ ID NO: 15960 - RNA, 18 nt, Artificial Sequence
  Synthetic
uuucauguuaagcaaaac

SEQ ID NO: 15961 - RNA, 19 nt, Artificial Sequence
  Synthetic
uuuucauguuaagcaaaac

SEQ ID NO: 15962 - RNA, 20 nt, Artificial Sequence
  Synthetic
auuuucauguuaagcaaaac

SEQ ID NO: 15963 - RNA, 21 nt, Artificial Sequence
  Synthetic
uauuuucauguuaagcaaaac

SEQ ID NO: 15964 - RNA, 22 nt, Artificial Sequence
  Synthetic
uuauuuucauguuaagcaaaac

SEQ ID NO: 15965 - RNA, 23 nt, Artificial Sequence
  Synthetic
auuauuuucauguuaagcaaaac

SEQ ID NO: 15966 - RNA, 24 nt, Artificial Sequence
  Synthetic
uauuauuuucauguuaagcaaaac

SEQ ID NO: 15967 - RNA, 18 nt, Artificial Sequence
  Synthetic
aguauuuucuuucauugg

SEQ ID NO: 15968 - RNA, 19 nt, Artificial Sequence
  Synthetic
aaguauuuucuuucauugg

SEQ ID NO: 15969 - RNA, 20 nt, Artificial Sequence
  Synthetic
uaaguauuuucuuucauugg

SEQ ID NO: 15970 - RNA, 21 nt, Artificial Sequence
  Synthetic
guaaguauuuucuuucauugg

SEQ ID NO: 15971 - RNA, 22 nt, Artificial Sequence
  Synthetic
aguaaguauuuucuuucauugg

SEQ ID NO: 15972 - RNA, 23 nt, Artificial Sequence
  Synthetic
caguaaguauuuucuuucauugg

SEQ ID NO: 15973 - RNA, 24 nt, Artificial Sequence
  Synthetic
acaguaaguauuuucuuucauugg

SEQ ID NO: 15974 - RNA, 18 nt, Artificial Sequence
  Synthetic
aaguauuuucuuucauug

SEQ ID NO: 15975 - RNA, 19 nt, Artificial Sequence
  Synthetic
uaaguauuuucuuucauug

SEQ ID NO: 15976 - RNA, 20 nt, Artificial Sequence
  Synthetic
guaaguauuuucuuucauug

SEQ ID NO: 15977 - RNA, 21 nt, Artificial Sequence
  Synthetic
aguaaguauuuucuuucauug

SEQ ID NO: 15978 - RNA, 22 nt, Artificial Sequence
  Synthetic
caguaaguauuuucuuucauug

SEQ ID NO: 15979 - RNA, 23 nt, Artificial Sequence
  Synthetic
acaguaaguauuuucuuucauug

SEQ ID NO: 15980 - RNA, 24 nt, Artificial Sequence
  Synthetic
uacaguaaguauuuucuuucauug

SEQ ID NO: 15981 - RNA, 18 nt, Artificial Sequence
  Synthetic
guaaguauuuucuuucau

SEQ ID NO: 15982 - RNA, 19 nt, Artificial Sequence
  Synthetic
aguaaguauuuucuuucau

SEQ ID NO: 15983 - RNA, 20 nt, Artificial Sequence
  Synthetic
caguaaguauuuucuuucau

SEQ ID NO: 15984 - RNA, 21 nt, Artificial Sequence
  Synthetic
acaguaaguauuuucuuucau

SEQ ID NO: 15985 - RNA, 22 nt, Artificial Sequence
  Synthetic
uacaguaaguauuuucuuucau

SEQ ID NO: 15986 - RNA, 23 nt, Artificial Sequence
  Synthetic
guacaguaaguauuuucuuucau

SEQ ID NO: 15987 - RNA, 24 nt, Artificial Sequence
  Synthetic
aguacaguaaguauuuucuuucau

SEQ ID NO: 15988 - RNA, 18 nt, Artificial Sequence
  Synthetic
uuggcuauugauacugau

SEQ ID NO: 15989 - RNA, 19 nt, Artificial Sequence
  Synthetic
uuuggcuauugauacugau

SEQ ID NO: 15990 - RNA, 20 nt, Artificial Sequence
  Synthetic
cuuuggcuauugauacugau

SEQ ID NO: 15991 - RNA, 21 nt, Artificial Sequence
  Synthetic
ucuuuggcuauugauacugau

SEQ ID NO: 15992 - RNA, 22 nt, Artificial Sequence
  Synthetic
aucuuuggcuauugauacugau

SEQ ID NO: 15993 - RNA, 23 nt, Artificial Sequence
  Synthetic
gaucuuuggcuauugauacugau

SEQ ID NO: 15994 - RNA, 24 nt, Artificial Sequence
  Synthetic
ggaucuuuggcuauugauacugau

SEQ ID NO: 15995 - RNA, 18 nt, Artificial Sequence
  Synthetic
uaaguauuuucuuucauu

SEQ ID NO: 15996 - RNA, 19 nt, Artificial Sequence
  Synthetic
guaaguauuuucuuucauu

SEQ ID NO: 15997 - RNA, 20 nt, Artificial Sequence
  Synthetic
aguaaguauuuucuuucauu

SEQ ID NO: 15998 - RNA, 21 nt, Artificial Sequence
  Synthetic
caguaaguauuuucuuucauu

SEQ ID NO: 15999 - RNA, 22 nt, Artificial Sequence
  Synthetic
acaguaaguauuuucuuucauu

SEQ ID NO: 16000 - RNA, 23 nt, Artificial Sequence
  Synthetic
uacaguaaguauuuucuuucauu

SEQ ID NO: 16001 - RNA, 24 nt, Artificial Sequence
  Synthetic
guacaguaaguauuuucuuucauu

SEQ ID NO: 16002 - RNA, 17 nt, Artificial Sequence
  Synthetic
ggaucuuuggcuauuga

SEQ ID NO: 16003 - RNA, 17 nt, Artificial Sequence
  Synthetic
ucgguaaaacuuucuag

SEQ ID NO: 16004 - RNA, 20 nt, Artificial Sequence
  Synthetic
uuuggaucuuuggcuauuga

SEQ ID NO: 16005 - RNA, 20 nt, Artificial Sequence
  Synthetic
cccuguuauggcuguaaaua

SEQ ID NO: 16006 - RNA, 20 nt, Artificial Sequence
  Synthetic
aauucgguaaaacuuucuag

SEQ ID NO: 16007 - RNA, 17 nt, Artificial Sequence
  Synthetic
cacugcgcccagccuua

SEQ ID NO: 16008 - RNA, 20 nt, Artificial Sequence
  Synthetic
agccacugcgcccagccuua

SEQ ID NO: 16009 - RNA, 17 nt, Artificial Sequence
  Synthetic
uguuauggcuguaaaua

SEQ ID NO: 16010 - RNA, 17 nt, Artificial Sequence
  Synthetic
guucaccuugccccaca

SEQ ID NO: 16011 - RNA, 17 nt, Artificial Sequence
  Synthetic
aggagucaggugcacca

SEQ ID NO: 16012 - RNA, 17 nt, Artificial Sequence
  Synthetic
uacugcccuguggggca

SEQ ID NO: 16013 - RNA, 17 nt, Artificial Sequence
  Synthetic
gcugggcauaaaaguca

SEQ ID NO: 16014 - RNA, 17 nt, Artificial Sequence
  Synthetic
guuacaagacagguuua

SEQ ID NO: 16015 - RNA, 17 nt, Artificial Sequence
  Synthetic
aggagaccaauagaaac

SEQ ID NO: 16016 - RNA, 17 nt, Artificial Sequence
  Synthetic
cguucaccuugccccac

SEQ ID NO: 16017 - RNA, 17 nt, Artificial Sequence
  Synthetic
acggcagacuucuccac

SEQ ID NO: 16018 - RNA, 17 nt, Artificial Sequence
  Synthetic
uaucaagguuacaagac

SEQ ID NO: 16019 - RNA, 17 nt, Artificial Sequence
  Synthetic
acuuuuaugcccagccc

SEQ ID NO: 16020 - RNA, 17 nt, Artificial Sequence
  Synthetic
ggcugggcauaaaaguc

SEQ ID NO: 16021 - RNA, 17 nt, Artificial Sequence
  Synthetic
acuucuccacaggaguc

SEQ ID NO: 16022 - RNA, 17 nt, Artificial Sequence
  Synthetic
aauagaaacugggcaug

SEQ ID NO: 16023 - RNA, 17 nt, Artificial Sequence
  Synthetic
cugccguuacugcccug

SEQ ID NO: 16024 - RNA, 17 nt, Artificial Sequence
  Synthetic
ggaugaaguugguggug

SEQ ID NO: 16025 - RNA, 17 nt, Artificial Sequence
  Synthetic
gccguuacugcccugug

SEQ ID NO: 16026 - RNA, 17 nt, Artificial Sequence
  Synthetic
acaugcccaguuucuau

SEQ ID NO: 16027 - RNA, 17 nt, Artificial Sequence
  Synthetic
ggagaccaauagaaacu

SEQ ID NO: 16028 - RNA, 17 nt, Artificial Sequence
  Synthetic
gugaacguggaugaagu

SEQ ID NO: 16029 - RNA, 17 nt, Artificial Sequence
  Synthetic
ugccguuacugcccugu

SEQ ID NO: 16030 - RNA, 20 nt, Artificial Sequence
  Synthetic
cuugccccacagggcaguaa

SEQ ID NO: 16031 - RNA, 20 nt, Artificial Sequence
  Synthetic
cacguucaccuugccccaca

SEQ ID NO: 16032 - RNA, 20 nt, Artificial Sequence
  Synthetic
cacaggagucaggugcacca

SEQ ID NO: 16033 - RNA, 20 nt, Artificial Sequence
  Synthetic
agcagggagggcaggagcca

SEQ ID NO: 16034 - RNA, 20 nt, Artificial Sequence
  Synthetic
cguuacugcccuguggggca

SEQ ID NO: 16035 - RNA, 20 nt, Artificial Sequence
  Synthetic
agggcugggcauaaaaguca

SEQ ID NO: 16036 - RNA, 20 nt, Artificial Sequence
  Synthetic
aagcaaauguaagcaauaga

SEQ ID NO: 16037 - RNA, 20 nt, Artificial Sequence
  Synthetic
aagguuacaagacagguuua

SEQ ID NO: 16038 - RNA, 20 nt, Artificial Sequence
  Synthetic
uuaaggagaccaauagaaac

SEQ ID NO: 16039 - RNA, 20 nt, Artificial Sequence
  Synthetic
guaacggcagacuucuccac

SEQ ID NO: 16040 - RNA, 20 nt, Artificial Sequence
  Synthetic
ugguaucaagguuacaagac

SEQ ID NO: 16041 - RNA, 20 nt, Artificial Sequence
  Synthetic
cugacuuuuaugcccagccc

SEQ ID NO: 16042 - RNA, 20 nt, Artificial Sequence
  Synthetic
ugaaguugguggugaggccc

SEQ ID NO: 16043 - RNA, 20 nt, Artificial Sequence
  Synthetic
gagcagggagggcaggagcc

SEQ ID NO: 16044 - RNA, 20 nt, Artificial Sequence
  Synthetic
cagggcugggcauaaaaguc

SEQ ID NO: 16045 - RNA, 20 nt, Artificial Sequence
  Synthetic
cagacuucuccacaggaguc

SEQ ID NO: 16046 - RNA, 20 nt, Artificial Sequence
  Synthetic
gugaacguggaugaaguugg

SEQ ID NO: 16047 - RNA, 20 nt, Artificial Sequence
  Synthetic
accaauagaaacugggcaug

SEQ ID NO: 16048 - RNA, 20 nt, Artificial Sequence
  Synthetic
agucugccguuacugcccug

SEQ ID NO: 16049 - RNA, 20 nt, Artificial Sequence
  Synthetic
cguggaugaaguugguggug

SEQ ID NO: 16050 - RNA, 20 nt, Artificial Sequence
  Synthetic
ucugccguuacugcccugug

SEQ ID NO: 16051 - RNA, 20 nt, Artificial Sequence
  Synthetic
uaaggagaccaauagaaacu

SEQ ID NO: 16052 - RNA, 20 nt, Artificial Sequence
  Synthetic
gaaguugguggugaggcccu

SEQ ID NO: 16053 - RNA, 20 nt, Artificial Sequence
  Synthetic
ggagggcaggagccagggcu

SEQ ID NO: 16054 - RNA, 20 nt, Artificial Sequence
  Synthetic
aaggugaacguggaugaagu

SEQ ID NO: 16055 - RNA, 20 nt, Artificial Sequence
  Synthetic
gucugccguuacugcccugu

SEQ ID NO: 16056 - RNA, 17 nt, Artificial Sequence
  Synthetic
gccccacagggcaguaa

SEQ ID NO: 16057 - RNA, 17 nt, Artificial Sequence
  Synthetic
guggugaggcccugggc

SEQ ID NO: 16058 - RNA, 17 nt, Artificial Sequence
  Synthetic
guggggcaaggugaacg

SEQ ID NO: 16059 - RNA, 17 nt, Artificial Sequence
  Synthetic
ggugcaccugacuccug

SEQ ID NO: 16060 - RNA, 17 nt, Artificial Sequence
  Synthetic
guugguggugaggcccu

SEQ ID NO: 16061 - RNA, 17 nt, Artificial Sequence
  Synthetic
gggcaggagccagggcu

SEQ ID NO: 16062 - RNA, 20 nt, Artificial Sequence
  Synthetic
gcaaccucaaacagacacca

SEQ ID NO: 16063 - RNA, 20 nt, Artificial Sequence
  Synthetic
gggagggcaggagccagggc

SEQ ID NO: 16064 - RNA, 17 nt, Artificial Sequence
  Synthetic
accucaaacagacacca

SEQ ID NO: 16065 - RNA, 17 nt, Artificial Sequence
  Synthetic
ugauaccaaccugccca

SEQ ID NO: 16066 - RNA, 17 nt, Artificial Sequence
  Synthetic
agggagggcaggagcca

SEQ ID NO: 16067 - RNA, 17 nt, Artificial Sequence
  Synthetic
ugggcagguugguauca

SEQ ID NO: 16068 - RNA, 17 nt, Artificial Sequence
  Synthetic
caaauguaagcaauaga

SEQ ID NO: 16069 - RNA, 17 nt, Artificial Sequence
  Synthetic
aguugguggugaggccc

SEQ ID NO: 16070 - RNA, 17 nt, Artificial Sequence
  Synthetic
uugauaccaaccugccc

SEQ ID NO: 16071 - RNA, 17 nt, Artificial Sequence
  Synthetic
cagggagggcaggagcc

SEQ ID NO: 16072 - RNA, 17 nt, Artificial Sequence
  Synthetic
agggcaggagccagggc

SEQ ID NO: 16073 - RNA, 17 nt, Artificial Sequence
  Synthetic
aacguggaugaaguugg

SEQ ID NO: 16074 - RNA, 17 nt, Artificial Sequence
  Synthetic
accauggugucuguuug

SEQ ID NO: 16075 - RNA, 17 nt, Artificial Sequence
  Synthetic
ugaggcccugggcaggu

SEQ ID NO: 16076 - RNA, 20 nt, Artificial Sequence
  Synthetic
ccuugauaccaaccugccca

SEQ ID NO: 16077 - RNA, 20 nt, Artificial Sequence
  Synthetic
cccugggcagguugguauca

SEQ ID NO: 16078 - RNA, 20 nt, Artificial Sequence
  Synthetic
ccacguucaccuugccccac

SEQ ID NO: 16079 - RNA, 20 nt, Artificial Sequence
  Synthetic
accuugauaccaaccugccc

SEQ ID NO: 16080 - RNA, 20 nt, Artificial Sequence
  Synthetic
uugguggugaggcccugggc

SEQ ID NO: 16081 - RNA, 20 nt, Artificial Sequence
  Synthetic
ccuguggggcaaggugaacg

SEQ ID NO: 16082 - RNA, 20 nt, Artificial Sequence
  Synthetic
cauggugcaccugacuccug

SEQ ID NO: 16083 - RNA, 20 nt, Artificial Sequence
  Synthetic
ugcaccauggugucuguuug

SEQ ID NO: 16084 - RNA, 20 nt, Artificial Sequence
  Synthetic
uggugaggcccugggcaggu

SEQ ID NO: 16085 - RNA, 18 nt, Artificial Sequence
  Synthetic
aacggcagacuucuccac

SEQ ID NO: 16086 - RNA, 19 nt, Artificial Sequence
  Synthetic
uaacggcagacuucuccac

SEQ ID NO: 16087 - RNA, 20 nt, Artificial Sequence
  Synthetic
guaacggcagacuucuccac

SEQ ID NO: 16088 - RNA, 21 nt, Artificial Sequence
  Synthetic
aguaacggcagacuucuccac

SEQ ID NO: 16089 - RNA, 22 nt, Artificial Sequence
  Synthetic
caguaacggcagacuucuccac

SEQ ID NO: 16090 - RNA, 23 nt, Artificial Sequence
  Synthetic
gcaguaacggcagacuucuccac

SEQ ID NO: 16091 - RNA, 24 nt, Artificial Sequence
  Synthetic
ggcaguaacggcagacuucuccac

SEQ ID NO: 16092 - RNA, 18 nt, Artificial Sequence
  Synthetic
cuguggggcaaggugaac

SEQ ID NO: 16093 - RNA, 19 nt, Artificial Sequence
  Synthetic
ccuguggggcaaggugaac

SEQ ID NO: 16094 - RNA, 20 nt, Artificial Sequence
  Synthetic
cccuguggggcaaggugaac

SEQ ID NO: 16095 - RNA, 21 nt, Artificial Sequence
  Synthetic
gcccuguggggcaaggugaac

SEQ ID NO: 16096 - RNA, 22 nt, Artificial Sequence
  Synthetic
ugcccuguggggcaaggugaac

SEQ ID NO: 16097 - RNA, 23 nt, Artificial Sequence
  Synthetic
cugcccuguggggcaaggugaac

SEQ ID NO: 16098 - RNA, 24 nt, Artificial Sequence
  Synthetic
acugcccuguggggcaaggugaac

SEQ ID NO: 16099 - RNA, 18 nt, Artificial Sequence
  Synthetic
cacguucaccuugcccca

SEQ ID NO: 16100 - RNA, 19 nt, Artificial Sequence
  Synthetic
ccacguucaccuugcccca

SEQ ID NO: 16101 - RNA, 20 nt, Artificial Sequence
  Synthetic
uccacguucaccuugcccca

SEQ ID NO: 16102 - RNA, 21 nt, Artificial Sequence
  Synthetic
auccacguucaccuugcccca

SEQ ID NO: 16103 - RNA, 22 nt, Artificial Sequence
  Synthetic
cauccacguucaccuugcccca

SEQ ID NO: 16104 - RNA, 23 nt, Artificial Sequence
  Synthetic
ucauccacguucaccuugcccca

SEQ ID NO: 16105 - RNA, 24 nt, Artificial Sequence
  Synthetic
uucauccacguucaccuugcccca

SEQ ID NO: 16106 - RNA, 18 nt, Artificial Sequence
  Synthetic
uaacggcagacuucucca

SEQ ID NO: 16107 - RNA, 19 nt, Artificial Sequence
  Synthetic
guaacggcagacuucucca

SEQ ID NO: 16108 - RNA, 20 nt, Artificial Sequence
  Synthetic
aguaacggcagacuucucca

SEQ ID NO: 16109 - RNA, 21 nt, Artificial Sequence
  Synthetic
caguaacggcagacuucucca

SEQ ID NO: 16110 - RNA, 22 nt, Artificial Sequence
  Synthetic
gcaguaacggcagacuucucca

SEQ ID NO: 16111 - RNA, 23 nt, Artificial Sequence
  Synthetic
ggcaguaacggcagacuucucca

SEQ ID NO: 16112 - RNA, 24 nt, Artificial Sequence
  Synthetic
gggcaguaacggcagacuucucca

SEQ ID NO: 16113 - RNA, 18 nt, Artificial Sequence
  Synthetic
gucuguuugagguugcua

SEQ ID NO: 16114 - RNA, 19 nt, Artificial Sequence
  Synthetic
ugucuguuugagguugcua

SEQ ID NO: 16115 - RNA, 20 nt, Artificial Sequence
  Synthetic
gugucuguuugagguugcua

SEQ ID NO: 16116 - RNA, 21 nt, Artificial Sequence
  Synthetic
ggugucuguuugagguugcua

SEQ ID NO: 16117 - RNA, 22 nt, Artificial Sequence
  Synthetic
uggugucuguuugagguugcua

SEQ ID NO: 16118 - RNA, 23 nt, Artificial Sequence
  Synthetic
auggugucuguuugagguugcua

SEQ ID NO: 16119 - RNA, 24 nt, Artificial Sequence
  Synthetic
cauggugucuguuugagguugcua

SEQ ID NO: 16120 - RNA, 18 nt, Artificial Sequence
  Synthetic
ccuugauaccaaccugcc

SEQ ID NO: 16121 - RNA, 19 nt, Artificial Sequence
  Synthetic
accuugauaccaaccugcc

SEQ ID NO: 16122 - RNA, 20 nt, Artificial Sequence
  Synthetic
aaccuugauaccaaccugcc

SEQ ID NO: 16123 - RNA, 21 nt, Artificial Sequence
  Synthetic
uaaccuugauaccaaccugcc

SEQ ID NO: 16124 - RNA, 22 nt, Artificial Sequence
  Synthetic
guaaccuugauaccaaccugcc

SEQ ID NO: 16125 - RNA, 23 nt, Artificial Sequence
  Synthetic
uguaaccuugauaccaaccugcc

SEQ ID NO: 16126 - RNA, 24 nt, Artificial Sequence
  Synthetic
uuguaaccuugauaccaaccugcc

SEQ ID NO: 16127 - RNA, 18 nt, Artificial Sequence
  Synthetic
gugcaccauggugucugu

SEQ ID NO: 16128 - RNA, 19 nt, Artificial Sequence
  Synthetic
ggugcaccauggugucugu

SEQ ID NO: 16129 - RNA, 20 nt, Artificial Sequence
  Synthetic
aggugcaccauggugucugu

SEQ ID NO: 16130 - RNA, 21 nt, Artificial Sequence
  Synthetic
caggugcaccauggugucugu

SEQ ID NO: 16131 - RNA, 22 nt, Artificial Sequence
  Synthetic
ucaggugcaccauggugucugu

SEQ ID NO: 16132 - RNA, 23 nt, Artificial Sequence
  Synthetic
gucaggugcaccauggugucugu

SEQ ID NO: 16133 - RNA, 24 nt, Artificial Sequence
  Synthetic
agucaggugcaccauggugucugu

SEQ ID NO: 16134 - RNA, 18 nt, Artificial Sequence
  Synthetic
uagugaacacaguugugu

SEQ ID NO: 16135 - RNA, 19 nt, Artificial Sequence
  Synthetic
cuagugaacacaguugugu

SEQ ID NO: 16136 - RNA, 20 nt, Artificial Sequence
  Synthetic
gcuagugaacacaguugugu

SEQ ID NO: 16137 - RNA, 21 nt, Artificial Sequence
  Synthetic
ugcuagugaacacaguugugu

SEQ ID NO: 16138 - RNA, 22 nt, Artificial Sequence
  Synthetic
uugcuagugaacacaguugugu

SEQ ID NO: 16139 - RNA, 23 nt, Artificial Sequence
  Synthetic
guugcuagugaacacaguugugu

SEQ ID NO: 16140 - RNA, 24 nt, Artificial Sequence
  Synthetic
gguugcuagugaacacaguugugu

SEQ ID NO: 16141 - RNA, 18 nt, Artificial Sequence
  Synthetic
uaaggagaccaauagaaa

SEQ ID NO: 16142 - RNA, 19 nt, Artificial Sequence
  Synthetic
uuaaggagaccaauagaaa

SEQ ID NO: 16143 - RNA, 20 nt, Artificial Sequence
  Synthetic
uuuaaggagaccaauagaaa

SEQ ID NO: 16144 - RNA, 21 nt, Artificial Sequence
  Synthetic
guuuaaggagaccaauagaaa

SEQ ID NO: 16145 - RNA, 22 nt, Artificial Sequence
  Synthetic
gguuuaaggagaccaauagaaa

SEQ ID NO: 16146 - RNA, 23 nt, Artificial Sequence
  Synthetic
agguuuaaggagaccaauagaaa

SEQ ID NO: 16147 - RNA, 24 nt, Artificial Sequence
  Synthetic
cagguuuaaggagaccaauagaaa

SEQ ID NO: 16148 - RNA, 18 nt, Artificial Sequence
  Synthetic
cagguuuaaggagaccaa

SEQ ID NO: 16149 - RNA, 19 nt, Artificial Sequence
  Synthetic
acagguuuaaggagaccaa

SEQ ID NO: 16150 - RNA, 20 nt, Artificial Sequence
  Synthetic
gacagguuuaaggagaccaa

SEQ ID NO: 16151 - RNA, 21 nt, Artificial Sequence
  Synthetic
agacagguuuaaggagaccaa

SEQ ID NO: 16152 - RNA, 22 nt, Artificial Sequence
  Synthetic
aagacagguuuaaggagaccaa

SEQ ID NO: 16153 - RNA, 23 nt, Artificial Sequence
  Synthetic
caagacagguuuaaggagaccaa

SEQ ID NO: 16154 - RNA, 24 nt, Artificial Sequence
  Synthetic
acaagacagguuuaaggagaccaa

SEQ ID NO: 16155 - RNA, 18 nt, Artificial Sequence
  Synthetic
gguuacaagacagguuua

SEQ ID NO: 16156 - RNA, 19 nt, Artificial Sequence
  Synthetic
agguuacaagacagguuua

SEQ ID NO: 16157 - RNA, 20 nt, Artificial Sequence
  Synthetic
aagguuacaagacagguuua

SEQ ID NO: 16158 - RNA, 21 nt, Artificial Sequence
  Synthetic
caagguuacaagacagguuua

SEQ ID NO: 16159 - RNA, 22 nt, Artificial Sequence
  Synthetic
ucaagguuacaagacagguuua

SEQ ID NO: 16160 - RNA, 23 nt, Artificial Sequence
  Synthetic
aucaagguuacaagacagguuua

SEQ ID NO: 16161 - RNA, 24 nt, Artificial Sequence
  Synthetic
uaucaagguuacaagacagguuua

SEQ ID NO: 16162 - RNA, 18 nt, Artificial Sequence
  Synthetic
gaaguugguggugaggcc

SEQ ID NO: 16163 - RNA, 19 nt, Artificial Sequence
  Synthetic
ugaaguugguggugaggcc

SEQ ID NO: 16164 - RNA, 20 nt, Artificial Sequence
  Synthetic
augaaguugguggugaggcc

SEQ ID NO: 16165 - RNA, 21 nt, Artificial Sequence
  Synthetic
gaugaaguugguggugaggcc

SEQ ID NO: 16166 - RNA, 22 nt, Artificial Sequence
  Synthetic
ggaugaaguugguggugaggcc

SEQ ID NO: 16167 - RNA, 23 nt, Artificial Sequence
  Synthetic
uggaugaaguugguggugaggcc

SEQ ID NO: 16168 - RNA, 24 nt, Artificial Sequence
  Synthetic
guggaugaaguugguggugaggcc

SEQ ID NO: 16169 - RNA, 18 nt, Artificial Sequence
  Synthetic
acugcccuguggggcaag

SEQ ID NO: 16170 - RNA, 19 nt, Artificial Sequence
  Synthetic
uacugcccuguggggcaag

SEQ ID NO: 16171 - RNA, 20 nt, Artificial Sequence
  Synthetic
uuacugcccuguggggcaag

SEQ ID NO: 16172 - RNA, 21 nt, Artificial Sequence
  Synthetic
guuacugcccuguggggcaag

SEQ ID NO: 16173 - RNA, 22 nt, Artificial Sequence
  Synthetic
cguuacugcccuguggggcaag

SEQ ID NO: 16174 - RNA, 23 nt, Artificial Sequence
  Synthetic
ccguuacugcccuguggggcaag

SEQ ID NO: 16175 - RNA, 24 nt, Artificial Sequence
  Synthetic
gccguuacugcccuguggggcaag

SEQ ID NO: 16176 - RNA, 18 nt, Artificial Sequence
  Synthetic
ggagggcaggagccaggg

SEQ ID NO: 16177 - RNA, 19 nt, Artificial Sequence
  Synthetic
gggagggcaggagccaggg

SEQ ID NO: 16178 - RNA, 20 nt, Artificial Sequence
  Synthetic
agggagggcaggagccaggg

SEQ ID NO: 16179 - RNA, 21 nt, Artificial Sequence
  Synthetic
cagggagggcaggagccaggg

SEQ ID NO: 16180 - RNA, 22 nt, Artificial Sequence
  Synthetic
gcagggagggcaggagccaggg

SEQ ID NO: 16181 - RNA, 23 nt, Artificial Sequence
  Synthetic
agcagggagggcaggagccaggg

SEQ ID NO: 16182 - RNA, 24 nt, Artificial Sequence
  Synthetic
gagcagggagggcaggagccaggg

SEQ ID NO: 16183 - RNA, 18 nt, Artificial Sequence
  Synthetic
ugggcauaaaagucaggg

SEQ ID NO: 16184 - RNA, 19 nt, Artificial Sequence
  Synthetic
cugggcauaaaagucaggg

SEQ ID NO: 16185 - RNA, 20 nt, Artificial Sequence
  Synthetic
gcugggcauaaaagucaggg

SEQ ID NO: 16186 - RNA, 21 nt, Artificial Sequence
  Synthetic
ggcugggcauaaaagucaggg

SEQ ID NO: 16187 - RNA, 22 nt, Artificial Sequence
  Synthetic
gggcugggcauaaaagucaggg

SEQ ID NO: 16188 - RNA, 23 nt, Artificial Sequence
  Synthetic
agggcugggcauaaaagucaggg

SEQ ID NO: 16189 - RNA, 24 nt, Artificial Sequence
  Synthetic
cagggcugggcauaaaagucaggg

SEQ ID NO: 16190 - RNA, 18 nt, Artificial Sequence
  Synthetic
ggggcaaggugaacgugg

SEQ ID NO: 16191 - RNA, 19 nt, Artificial Sequence
  Synthetic
uggggcaaggugaacgugg

SEQ ID NO: 16192 - RNA, 20 nt, Artificial Sequence
  Synthetic
guggggcaaggugaacgugg

SEQ ID NO: 16193 - RNA, 21 nt, Artificial Sequence
  Synthetic
uguggggcaaggugaacgugg

SEQ ID NO: 16194 - RNA, 22 nt, Artificial Sequence
  Synthetic
cuguggggcaaggugaacgugg

SEQ ID NO: 16195 - RNA, 23 nt, Artificial Sequence
  Synthetic
ccuguggggcaaggugaacgugg

SEQ ID NO: 16196 - RNA, 24 nt, Artificial Sequence
  Synthetic
cccuguggggcaaggugaacgugg

SEQ ID NO: 16197 - RNA, 18 nt, Artificial Sequence
  Synthetic
ucugccguuacugcccug

SEQ ID NO: 16198 - RNA, 19 nt, Artificial Sequence
  Synthetic
gucugccguuacugcccug

SEQ ID NO: 16199 - RNA, 20 nt, Artificial Sequence
  Synthetic
agucugccguuacugcccug

SEQ ID NO: 16200 - RNA, 21 nt, Artificial Sequence
  Synthetic
aagucugccguuacugcccug

SEQ ID NO: 16201 - RNA, 22 nt, Artificial Sequence
  Synthetic
gaagucugccguuacugcccug

SEQ ID NO: 16202 - RNA, 23 nt, Artificial Sequence
  Synthetic
agaagucugccguuacugcccug

SEQ ID NO: 16203 - RNA, 24 nt, Artificial Sequence
  Synthetic
gagaagucugccguuacugcccug

SEQ ID NO: 16204 - RNA, 18 nt, Artificial Sequence
  Synthetic
uggugcaccugacuccug

SEQ ID NO: 16205 - RNA, 19 nt, Artificial Sequence
  Synthetic
auggugcaccugacuccug

SEQ ID NO: 16206 - RNA, 20 nt, Artificial Sequence
  Synthetic
cauggugcaccugacuccug

SEQ ID NO: 16207 - RNA, 21 nt, Artificial Sequence
  Synthetic
ccauggugcaccugacuccug

SEQ ID NO: 16208 - RNA, 22 nt, Artificial Sequence
  Synthetic
accauggugcaccugacuccug

SEQ ID NO: 16209 - RNA, 23 nt, Artificial Sequence
  Synthetic
caccauggugcaccugacuccug

SEQ ID NO: 16210 - RNA, 24 nt, Artificial Sequence
  Synthetic
acaccauggugcaccugacuccug

SEQ ID NO: 16211 - RNA, 18 nt, Artificial Sequence
  Synthetic
acguggaugaaguuggug

SEQ ID NO: 16212 - RNA, 19 nt, Artificial Sequence
  Synthetic
aacguggaugaaguuggug

SEQ ID NO: 16213 - RNA, 20 nt, Artificial Sequence
  Synthetic
gaacguggaugaaguuggug

SEQ ID NO: 16214 - RNA, 21 nt, Artificial Sequence
  Synthetic
ugaacguggaugaaguuggug

SEQ ID NO: 16215 - RNA, 22 nt, Artificial Sequence
  Synthetic
gugaacguggaugaaguuggug

SEQ ID NO: 16216 - RNA, 23 nt, Artificial Sequence
  Synthetic
ggugaacguggaugaaguuggug

SEQ ID NO: 16217 - RNA, 24 nt, Artificial Sequence
  Synthetic
aggugaacguggaugaaguuggug

SEQ ID NO: 16218 - RNA, 18 nt, Artificial Sequence
  Synthetic
gugcaccugacuccugug

SEQ ID NO: 16219 - RNA, 19 nt, Artificial Sequence
  Synthetic
ggugcaccugacuccugug

SEQ ID NO: 16220 - RNA, 20 nt, Artificial Sequence
  Synthetic
uggugcaccugacuccugug

SEQ ID NO: 16221 - RNA, 21 nt, Artificial Sequence
  Synthetic
auggugcaccugacuccugug

SEQ ID NO: 16222 - RNA, 22 nt, Artificial Sequence
  Synthetic
cauggugcaccugacuccugug

SEQ ID NO: 16223 - RNA, 23 nt, Artificial Sequence
  Synthetic
ccauggugcaccugacuccugug

SEQ ID NO: 16224 - RNA, 24 nt, Artificial Sequence
  Synthetic
accauggugcaccugacuccugug

SEQ ID NO: 16225 - RNA, 18 nt, Artificial Sequence
  Synthetic
gucugccguuacugcccu

SEQ ID NO: 16226 - RNA, 19 nt, Artificial Sequence
  Synthetic
agucugccguuacugcccu

SEQ ID NO: 16227 - RNA, 20 nt, Artificial Sequence
  Synthetic
aagucugccguuacugcccu

SEQ ID NO: 16228 - RNA, 21 nt, Artificial Sequence
  Synthetic
gaagucugccguuacugcccu

SEQ ID NO: 16229 - RNA, 22 nt, Artificial Sequence
  Synthetic
agaagucugccguuacugcccu

SEQ ID NO: 16230 - RNA, 23 nt, Artificial Sequence
  Synthetic
gagaagucugccguuacugcccu

SEQ ID NO: 16231 - RNA, 24 nt, Artificial Sequence
  Synthetic
ggagaagucugccguuacugcccu

SEQ ID NO: 16232 - RNA, 18 nt, Artificial Sequence
  Synthetic
auggugcaccugacuccu

SEQ ID NO: 16233 - RNA, 19 nt, Artificial Sequence
  Synthetic
cauggugcaccugacuccu

SEQ ID NO: 16234 - RNA, 20 nt, Artificial Sequence
  Synthetic
ccauggugcaccugacuccu

SEQ ID NO: 16235 - RNA, 21 nt, Artificial Sequence
  Synthetic
accauggugcaccugacuccu

SEQ ID NO: 16236 - RNA, 22 nt, Artificial Sequence
  Synthetic
caccauggugcaccugacuccu

SEQ ID NO: 16237 - RNA, 23 nt, Artificial Sequence
  Synthetic
acaccauggugcaccugacuccu

SEQ ID NO: 16238 - RNA, 24 nt, Artificial Sequence
  Synthetic
gacaccauggugcaccugacuccu

SEQ ID NO: 16239 - RNA, 18 nt, Artificial Sequence
  Synthetic
agggcugggcauaaaagu

SEQ ID NO: 16240 - RNA, 19 nt, Artificial Sequence
  Synthetic
cagggcugggcauaaaagu

SEQ ID NO: 16241 - RNA, 20 nt, Artificial Sequence
  Synthetic
ccagggcugggcauaaaagu

SEQ ID NO: 16242 - RNA, 21 nt, Artificial Sequence
  Synthetic
gccagggcugggcauaaaagu

SEQ ID NO: 16243 - RNA, 22 nt, Artificial Sequence
  Synthetic
agccagggcugggcauaaaagu

SEQ ID NO: 16244 - RNA, 23 nt, Artificial Sequence
  Synthetic
gagccagggcugggcauaaaagu

SEQ ID NO: 16245 - RNA, 24 nt, Artificial Sequence
  Synthetic
ggagccagggcugggcauaaaagu

SEQ ID NO: 16246 - RNA, 18 nt, Artificial Sequence
  Synthetic
agguuacaagacagguuu

SEQ ID NO: 16247 - RNA, 19 nt, Artificial Sequence
  Synthetic
aagguuacaagacagguuu

SEQ ID NO: 16248 - RNA, 20 nt, Artificial Sequence
  Synthetic
caagguuacaagacagguuu

SEQ ID NO: 16249 - RNA, 21 nt, Artificial Sequence
  Synthetic
ucaagguuacaagacagguuu

SEQ ID NO: 16250 - RNA, 22 nt, Artificial Sequence
  Synthetic
aucaagguuacaagacagguuu

SEQ ID NO: 16251 - RNA, 23 nt, Artificial Sequence
  Synthetic
uaucaagguuacaagacagguuu

SEQ ID NO: 16252 - RNA, 24 nt, Artificial Sequence
  Synthetic
guaucaagguuacaagacagguuu

SEQ ID NO: 16253 - RNA, 17 nt, Artificial Sequence
  Synthetic
agccaucuauugcuuac

SEQ ID NO: 16254 - RNA, 17 nt, Artificial Sequence
  Synthetic
gucagggcagagccauc

SEQ ID NO: 16255 - RNA, 20 nt, Artificial Sequence
  Synthetic
cagagccaucuauugcuuac

SEQ ID NO: 16256 - RNA, 20 nt, Artificial Sequence
  Synthetic
aaagucagggcagagccauc

SEQ ID NO: 16257 - DNA, 1072 bp, Artificial Sequence
  Synthetic
ataggaacttgaatcaaggaaatgattttaaaacgcagtattcttagtggactagaggaaaaaaataatctgagccaagtagaagaccttttcccctcctacccctactttctaagtcacagaggctttttgttcccccagacactcttgcagattagtccaggcagaaacagttagatgtccccagttaacctcctatttgacaccactgattaccccattgatagtcacactttgggttgtaagtgactttttatttatttgtatttttgactgcattaagaggtctctagttttttatctcttgtttcccaaaacctaataagtaactaatgcacagagcacattgatttgtatttattctatttttagacataatttattagcatgcatgagcaaattaagaaaaacaacaacaaatgaatgcatatatatgtatatgtatgtgtgtatatatacacacatatatatatatattttttcttttcttaccagaaggttttaatccaaataaggagaagatatgcttagaaccgaggtagagttttcatccattctgtcctgtaagtattttgcatattctggagacgcaggaagagatccatctacatatcccaaagctgaattatggtagacaaaactcttccacttttagtgcatcaacttcttatttgtgtaataagaaaattgggaaaacgatcttcaatatgcttaccaagctgtgattccaaatattacgtaaatacacttgcaaaggaggatgtttttagtagcaatttgtactgatggtatggggccaagagatatatcttagagggagggctgagggtttgaagtccaactcctaagccagtgccagaagagccaaggacaggtacggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctg

SEQ ID NO: 16258 - DNA, 1128 bp, Artificial Sequence
  Synthetic
ggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactg

SEQ ID NO: 16259 - DNA, 2201 bp, Artificial Sequence
  Synthetic
ataggaacttgaatcaaggaaatgattttaaaacgcagtattcttagtggactagaggaaaaaaataatctgagccaagtagaagaccttttcccctcctacccctactttctaagtcacagaggctttttgttcccccagacactcttgcagattagtccaggcagaaacagttagatgtccccagttaacctcctatttgacaccactgattaccccattgatagtcacactttgggttgtaagtgactttttatttatttgtatttttgactgcattaagaggtctctagttttttatctcttgtttcccaaaacctaataagtaactaatgcacagagcacattgatttgtatttattctatttttagacataatttattagcatgcatgagcaaattaagaaaaacaacaacaaatgaatgcatatatatgtatatgtatgtgtgtatatatacacacatatatatatatattttttcttttcttaccagaaggttttaatccaaataaggagaagatatgcttagaaccgaggtagagttttcatccattctgtcctgtaagtattttgcatattctggagacgcaggaagagatccatctacatatcccaaagctgaattatggtagacaaaactcttccacttttagtgcatcaacttcttatttgtgtaataagaaaattgggaaaacgatcttcaatatgcttaccaagctgtgattccaaatattacgtaaatacacttgcaaaggaggatgtttttagtagcaatttgtactgatggtatggggccaagagatatatcttagagggagggctgagggtttgaagtccaactcctaagccagtgccagaagagccaaggacaggtacggctgtcatcacttagacctcaccctgtggagccacaccctagggttggccaatctactcccaggagcagggagggcaggagccagggctgggcataaaagtcagggcagagccatctattgcttacatttgcttctgacacaactgtgttcactagcaacctcaaacagacaccatggtgcatctgactcctgaggagaagtctgccgttactgccctgtggggcaaggtgaacgtggatgaagttggtggtgaggccctgggcaggttggtatcaaggttacaagacaggtttaaggagaccaatagaaactgggcatgtggagacagagaagactcttgggtttctgataggcactgactctctctgcctattggtctattttcccacccttaggctgctggtggtctacccttggacccagaggttctttgagtcctttggggatctgtccactcctgatgctgttatgggcaaccctaaggtgaaggctcatggcaagaaagtgctcggtgcctttagtgatggcctggctcacctggacaacctcaagggcacctttgccacactgagtgagctgcactgtgacaagctgcacgtggatcctgagaacttcagggtgagtctatgggacgcttgatgttttctttccccttcttttctatggttaagttcatgtcataggaaggggataagtaacagggtacagtttagaatgggaaacagacgaatgattgcatcagtgtggaagtctcaggatcgttttagtttcttttatttgctgttcataacaattgttttcttttgtttaattcttgctttctttttttttcttctccgcaatttttactattatacttaatgccttaacattgtgtataacaaaaggaaatatctctgagatacattaagtaacttaaaaaaaaactttacacagtctgcctagtacattactatttggaatatatgtgtgcttatttgcatattcataatctccctactttattttcttttatttttaattgatacataatcattatacatatttatgggttaaagtgtaatgttttaatatgtgtacacatattgaccaaatcagggtaattttgcatttgtaattttaaaaaatgctttcttcttttaatatacttttttgtttatcttatttctaatactttccctaatctctttctttcagggcaataatgatacaatgtatcatgcctctttgcaccattctaaagaataacagtgataatttctgggttaaggcaatagcaatatctctgcatataaatatttctgcatataaattgtaactg

SEQ ID NO: 16260 - DNA, 103 bp, Artificial Sequence
  Synthetic
actgtgttcactagcaacctcaaacagacaccatggtgcatctgactcctggggagaagtctgccgttactgccctgtggggcaaggtgaacgtggatgaagt

SEQ ID NO: 16261 - RNA, 20 nt, Artificial Sequence
  Synthetic
gugcuacuuauacaauucac

SEQ ID NO: 16262 - RNA, 20 nt, Artificial Sequence
  Synthetic
gaaaauacuuacuguacugc

SEQ ID NO: 16263 - RNA, 20 nt, Artificial Sequence
  Synthetic
ggcuguuuuggaauguagag

SEQ ID NO: 16264 - RNA, 20 nt, Artificial Sequence
  Synthetic
auucacuggaaacccuguua

SEQ ID NO: 16265 - RNA, 20 nt, Artificial Sequence
  Synthetic
uacuguacugcaggggaauu

SEQ ID NO: 16266 - RNA, 20 nt, Artificial Sequence
  Synthetic
aaacuauuuacagccauaac

SEQ ID NO: 16267 - RNA, 20 nt, Artificial Sequence
  Synthetic
aaauacuuacuguacugcag

SEQ ID NO: 16268 - RNA, 17 nt, Artificial Sequence
  Synthetic
cuauuuacagccauaac

SEQ ID NO: 16269 - RNA, 17 nt, Artificial Sequence
  Synthetic
cuacuuauacaauucac

SEQ ID NO: 16270 - RNA, 17 nt, Artificial Sequence
  Synthetic
cacuggaaacccuguua

SEQ ID NO: 16271 - RNA, 17 nt, Artificial Sequence
  Synthetic
uacuuacuguacugcag

SEQ ID NO: 16272 - RNA, 17 nt, Artificial Sequence
  Synthetic
uguacugcaggggaauu

SEQ ID NO: 16273 - RNA, 17 nt, Artificial Sequence
  Synthetic
aauacuuacuguacugc

SEQ ID NO: 16274 - RNA, 17 nt, Artificial Sequence
  Synthetic
auacuuacuguacugca

SEQ ID NO: 16275 - RNA, 17 nt, Artificial Sequence
  Synthetic
gaauguagagaggcaga

SEQ ID NO: 16276 - RNA, 17 nt, Artificial Sequence
  Synthetic
ggaauguagagaggcag

SEQ ID NO: 16277 - RNA, 20 nt, Artificial Sequence
  Synthetic
guaaguauuuucuuucauug

SEQ ID NO: 16278 - RNA, 20 nt, Artificial Sequence
  Synthetic
guaauuaagaaagcagugua

SEQ ID NO: 16279 - RNA, 17 nt, Artificial Sequence
  Synthetic
guauuuucuuucauugg

SEQ ID NO: 16280 - RNA, 20 nt, Artificial Sequence
  Synthetic
uggcauccaggucacgccag

SEQ ID NO: 16281 - RNA, 20 nt, Artificial Sequence
  Synthetic
gaugcuuuuuucaucucgau

SEQ ID NO: 16282 - RNA, 20 nt, Artificial Sequence
  Synthetic
gcauccaaucccguggaggu

SEQ ID NO: 16283 - RNA, 20 nt, Artificial Sequence
  Synthetic
uuuucaucucgauuggugaa

SEQ ID NO: 16284 - RNA, 20 nt, Artificial Sequence
  Synthetic
ccagaugaacuucccauugg

SEQ ID NO: 16285 - RNA, 20 nt, Artificial Sequence
  Synthetic
aggaggucaugauccccuuc

SEQ ID NO: 16286 - RNA, 17 nt, Artificial Sequence
  Synthetic
cauccaggucacgccag

SEQ ID NO: 16287 - RNA, 17 nt, Artificial Sequence
  Synthetic
gcuuuuuucaucucgau

SEQ ID NO: 16288 - RNA, 17 nt, Artificial Sequence
  Synthetic
uccaaucccguggaggu

SEQ ID NO: 16289 - RNA, 17 nt, Artificial Sequence
  Synthetic
ucaucucgauuggugaa

SEQ ID NO: 16290 - RNA, 17 nt, Artificial Sequence
  Synthetic
gaugaacuucccauugg

SEQ ID NO: 16291 - DNA, 23 bp, Artificial Sequence
  Synthetic
tgcctacatctgattcagtgagg

SEQ ID NO: 16292 - DNA, 22 bp, Artificial Sequence
  Synthetic
tgcctcattgacaaatttgctc

SEQ ID NO: 16293 - DNA, 20 bp, Artificial Sequence
  Synthetic
agaccgtctctttggtgcag

SEQ ID NO: 16294 - DNA, 20 bp, Artificial Sequence
  Synthetic
gcagtggctttaggctgttt

SEQ ID NO: 16295 - DNA, 20 bp, Artificial Sequence
  Synthetic
gtgtgatctcggctcaccac

SEQ ID NO: 16296 - DNA, 20 bp, Artificial Sequence
  Synthetic
ccctgactttggagctcagc

SEQ ID NO: 16297 - DNA, 59 bp, Artificial Sequence
  Synthetic
ctcctgaggagaagtctgccgttactgccctgtggggcaagggtgaacgtggatgaagt

SEQ ID NO: 16298 - DNA, 58 bp, Artificial Sequence
  Synthetic
ctcctgaggagaagtctgccgttactgccctgtggggcaagatgaacgtggatgaagt

SEQ ID NO: 16299 - DNA, 33 bp, Artificial Sequence
  Synthetic
ctgttttgggctgttttggaatgtagagggggc

SEQ ID NO: 16300 - DNA, 36 bp, Artificial Sequence
  Synthetic
ttacagccagtgaattgtataagtagcactgtataa

SEQ ID NO: 16301 - DNA, 32 bp, Artificial Sequence
  Synthetic
aataaaaggctgttttggaatgtagagaggca

SEQ ID NO: 16302 - DNA, 34 bp, Artificial Sequence
  Synthetic
aaccctgtgaattgtataagtagcacgagttctg

SEQ ID NO: 16303 - DNA, 20 bp, Artificial Sequence
  Synthetic
aataaaaggctgttttggaa

SEQ ID NO: 16304 - DNA, 14 bp, Artificial Sequence
  Synthetic
tgtataagtagcac

SEQ ID NO: 16305 - DNA, 24 bp, Artificial Sequence
  SYNTHETIC
aataaaaggctgttttggaatgta

SEQ ID NO: 16306 - DNA, 17 bp, Artificial Sequence
  SYNTHETIC
aattgtataagtagcac

SEQ ID NO: 16307 - DNA, 23 bp, Artificial Sequence
  SYNTHETIC
aataaaaggctgttttggaatgt

SEQ ID NO: 16308 - DNA, 17 bp, Artificial Sequence
  SYNTHETIC
aattgtataagtagcac

SEQ ID NO: 16309 - DNA, 24 bp, Artificial Sequence
  SYNTHETIC
aataaaaggctgttttggaatgta

SEQ ID NO: 16310 - DNA, 9 bp, Artificial Sequence
  SYNTHETIC
aagtagcac

SEQ ID NO: 16311 - DNA, 19 bp, Artificial Sequence
  SYNTHETIC
aataaaaggctgttttgga

SEQ ID NO: 16312 - DNA, 11 bp, Artificial Sequence
  SYNTHETIC
ataagtagcac

SEQ ID NO: 16313 - DNA, 14 bp, Artificial Sequence
  SYNTHETIC
aataaaaggctgtt

SEQ ID NO: 16314 - DNA, 15 bp, Artificial Sequence
  SYNTHETIC
ttgtataagtagcac

SEQ ID NO: 16315 - DNA, 30 bp, Artificial Sequence
  SYNTHETIC
ctgttttggaatgtagagaggcagaggggc

SEQ ID NO: 16316 - DNA, 36 bp, Artificial Sequence
  SYNTHETIC
ttacagccataacagggtttccagtgaattgtataa

SEQ ID NO: 16317 - DNA, 30 bp, Artificial Sequence; identical to SEQ ID NO: 16315
  SYNTHETIC

SEQ ID NO: 16318 - DNA, 36 bp, Artificial Sequence; identical to SEQ ID NO: 16316
  SYNTHETIC

SEQ ID NO: 16319 - DNA, 11 bp, Artificial Sequence
  SYNTHETIC
ctgttttggaa

SEQ ID NO: 16320 - DNA, 5 bp, Artificial Sequence
  SYNTHETIC
tgtat

SEQ ID NO: 16321 - DNA, 15 bp, Artificial Sequence
  SYNTHETIC
ctgttttggaatgta

SEQ ID NO: 16322 - DNA, 5 bp, Artificial Sequence
  SYNTHETIC
tgtat

SEQ ID NO: 16323 - DNA, 15 bp, Artificial Sequence
  SYNTHETIC
ctgttttggaatgta

SEQ ID NO: 16324 - DNA, 8 bp, Artificial Sequence
  SYNTHETIC
aattgtat

SEQ ID NO: 16325 - DNA, 8 bp, Artificial Sequence
  SYNTHETIC
ctgttttg

SEQ ID NO: 16326 - DNA, 9 bp, Artificial Sequence
  SYNTHETIC
gaattgtat

SEQ ID NO: 16327 - DNA, 13 bp, Artificial Sequence
  SYNTHETIC
ctgttttggaatg

SEQ ID NO: 16328 - DNA, 9 bp, Artificial Sequence
  SYNTHETIC
gaattgtat

SEQ ID NO: 16329 - DNA, 15 bp, Artificial Sequence
  SYNTHETIC
ctgttttggaatgta

SEQ ID NO: 16330 - DNA, 4 bp, Artificial Sequence
  SYNTHETIC
gtat

SEQ ID NO: 16331 - DNA, 68 bp, Artificial Sequence
  SYNTHETIC
ccaccaacttcatccacgttcaccttgccccacagggcagtaacggcagacttctcctcaggagtcag

SEQ ID NO: 16332 - DNA, 69 bp, Artificial Sequence
  SYNTHETIC
ccaccaactgcatccacgttcactttgccccacagggcattagacagcagtcttctcctcaggagtcag

SEQ ID NO: 16333 - DNA, 38 bp, Artificial Sequence
  SYNTHETIC
tccacgttcaccttgccccacagggcagtaacggcaga

SEQ ID NO: 16334 - DNA, 57 bp, Artificial Sequence
  SYNTHETIC
ccaacttcatccacgttcaccttgccccacagggcagtaacggcagacttctcctca

SEQ ID NO: 16335 - DNA, 67 bp, Artificial Sequence
  SYNTHETIC
caccaccaacttcatccacgttcaccttgccccacagggcagtaacggcagacttctcctcaggagt

SEQ ID NO: 16336 - DNA, 67 bp, Artificial Sequence
  SYNTHETIC
caccacgaacttcatccacgttaagcttgccctgcagggcagtaacggccgacttctccacacgagt
